US010993998B2

(12) United States Patent
Chan et al.

(10) Patent No.: US 10,993,998 B2
(45) Date of Patent: May 4, 2021

(54) DETERMINANTS OF CANCER RESPONSE TO IMMUNOTHERAPY BY PD-1 BLOCKADE

(71) Applicant: Memorial Sloan Kettering Cancer Center, New York, NY (US)

(72) Inventors: Timothy A. Chan, Cortlandt Manor, NY (US); Naiyer A. Rizvi, New York, NY (US); Matthew D. Hellmann, New York, NY (US)

(73) Assignee: Memorial Sloan Kettering Cancer Center, New York, NY (US)

( * ) Notice: Subject to any disclaimer, the term of this patent is extended or adjusted under 35 U.S.C. 154(b) by 0 days.

(21) Appl. No.: 16/283,555

(22) Filed: Feb. 22, 2019

(65) Prior Publication Data
US 2020/0040049 A1 Feb. 6, 2020

Related U.S. Application Data

(63) Continuation of application No. 15/528,385, filed as application No. PCT/US2015/062208 on Nov. 23, 2015, now abandoned.

(60) Provisional application No. 62/132,381, filed on Mar. 12, 2015, provisional application No. 62/083,088, filed on Nov. 21, 2014.

(51) Int. Cl.
*A61K 39/00* (2006.01)
*C07K 16/28* (2006.01)
*C12Q 1/6886* (2018.01)
*A61P 35/00* (2006.01)
*C12Q 1/68* (2018.01)
*A61P 35/02* (2006.01)
*A61P 35/04* (2006.01)
*C07K 14/47* (2006.01)

(52) U.S. Cl.
CPC .......... *A61K 39/0011* (2013.01); *A61P 35/00* (2018.01); *A61P 35/02* (2018.01); *A61P 35/04* (2018.01); *C07K 14/4748* (2013.01); *C07K 16/2818* (2013.01); *C12Q 1/68* (2013.01); *C12Q 1/6886* (2013.01); *A61K 2039/505* (2013.01); *A61K 2039/55* (2013.01); *C07K 2317/21* (2013.01); *C07K 2317/24* (2013.01); *C07K 2317/76* (2013.01); *C12Q 2600/106* (2013.01); *C12Q 2600/156* (2013.01)

(58) Field of Classification Search
None
See application file for complete search history.

(56) References Cited

U.S. PATENT DOCUMENTS

2004/0033497 A1   2/2004   Alarcon-Riquelme et al.
2010/0233202 A1   9/2010   Yoshida et al.
2011/0293637 A1*  12/2011  Hacohen ............... A61K 45/06
                                                    424/173.1
2013/0295110 A1   11/2013  Binder et al.
2016/0326597 A1*  11/2016  Chan .................... C12Q 1/6886
2018/0291074 A1   10/2018  Chan et al.

FOREIGN PATENT DOCUMENTS

WO   WO-2014/052707 A2   4/2014
WO   WO-2015/103037 A2   7/2015
WO   WO-2016/077553 A1   5/2016
WO   WO-2016/081947 A2   5/2016

OTHER PUBLICATIONS

Brown et al. (Genome Res. Apr. 29, 2014 24: 743-750 (Year: 2014).*
Abaan, O. et al., The exomes of the NCI-60 panel: a genomic resource for cancer biology and systems pharmacology, Cancer Research, 73(14):4372-4382 (2013).
Adzhubei, I. et al., A method and server for predicting damaging missense mutations, Nature Methods, 7(4):248-249 (2010).
Alexandrov, L. et al., Signatures of mutational processes in human cancer, Nature, 500:415-421 (2013).
Andersen, R. et al., Parallel detection of antigen-specific T cell responses by combinatorial encoding of MHC multimers, Nature Protocols, 7(5):891-902 (2012).
Ansell, S. et al., PD-1 blockade with nivolumab in relapsed or refractory Hodgkin's lymphoma, N Engl J Med., 372(4):311-319 (2015).
Bei, R. and Scardino, A., TAA polyepitope DNA-based vaccines: a potential tool for cancer therapy, J. Biomed. Biotechnol., 2010:102758 (2010).
Berzofsky, J.A. et al., Progress on new vaccine strategies for the immunotherapy and prevention of cancer, J. Clin. Invest., 113(11):1515-25 (2004).
Callahan, M. K. et al, At the Bedside: CTLA-4- and PD-1-blocking antibodies in cancer immunotherapy, Journal of Leukocyte Biology, 94: 41-53 (2013).
Castle, J. et al., Exploiting the mutanome for tumor vaccination, Cancer Research, 72(5):1081-1091 (2012).
Champiat, S. et al, Exomics and immunogenics: Bridging mutational load and immune checkpoints efficacy, Oncoiummonology, 3(1): e27817 (2014).
Charen, A. et al., The neoantigen landscape underlying clinical response to ipilimumab, J Clin Oncol, 31(15): Abstract 3003 (2014).
Cibulskis, K. et al., Sensitive detection of somatic point mutations in impure and heterogeneous cancer samples, Nat. Biotechnol., 31(3):213-219 (2013).

(Continued)

*Primary Examiner* — Peter J Reddig
(74) *Attorney, Agent, or Firm* — Brenda Herschbach Jarrell; Michael L. Vetter; Choate, Hall & Stewart LLP

(57) ABSTRACT

Molecular determinants of cancer response to immunotherapy are described, as are systems and tools for identifying and/or characterizing cancers likely to respond to immunotherapy.

18 Claims, 167 Drawing Sheets

Specification includes a Sequence Listing.

(56) References Cited

OTHER PUBLICATIONS

Coley, W., The treatment of malignant tumors by repeated inoculations of erysipelas. With a report of ten original cases, Clinical Orthopaedics and Related Research, 262: 3-11 (1991).
De Baets, G. et al., SNPeffect 4.0: on-line prediction of molecular and structural effects of protein-coding variants, Nucleic Acids Res, 40:D935-939 (2012).
Depristo, M. et al., A framework for variation discovery and genotyping using next-generation DNA sequencing data, Nature Genetics, 43(5):491-498 (2011).
Dogan, S. et al., Molecular epidemiology of EGFR and KRAS mutations in 3,026 lung adenocarcinomas: higher susceptibility of women to smoking-related KRAS-mutant cancers, Clinical Cancer Research, 18(22):6169-6177 (2012).
Duan, F. et al., Genomic and bioinformatic profiling of mutational neoepitopes reveals new rules to predict anticancer immunogenicity, J Exp Med., 211(11):2231-2248 (2014).
Garon, E. et al., Antitumor activity of pembrolizumab (pembro; mk-3475) and correlation with programmed death ligand 1 (pd-l1) expression in a pooled analysis of patients (pts) with advanced non-small cell lung carcinoma (NSCLC)., Annals of Oncology, 25(Supp. 25): V1-V41, Abstract LBA43 (2014).
Goodwin, J. & Knudsen, K., Beyond DNA Repair: DNA-PK Function in Cancer, Cancer Discovery, 4:1126-1139 (2014).
Govindan, R. et al., Genomic Landscape of Non-Small Cell Lung Cancer in Smokers and Never-Smokers, Cell, 150:1121-1134 (2012).
Gubin, M. et al., Checkpoint blockade cancer immunotherapy targets tumour-specific mutant antigens, Nature, 515:577-581 (2014).
Hamid, O. et al, Safety and Tumor Responses with Lambrolizumab (Anti-PD-1) in Melanoma, New England Journal of Medicine, 369(2): 134-144 (2013).
Hammerman, P. et al., Comprehensive genomic characterization of squamous cell lung cancers, Nature, 489:519-525 (2012).
Herbst, R. et al., Predictive correlates of response to the anti-PD-L1 antibody MPDL3280A in cancer patients, Nature, 515(7528):563-567 (2014).
Hindges, R. et al., DNA polymerase delta, an essential enzyme for DNA transactions, Biological Chemistry, 378:345-362 (1997).
Ho, A. et al., The mutational landscape of adenoid cystic carcinoma, Nature Genetics, 45(7):791-798 (2013).
Hodi, F. et al., Improved survival with ipilimumab in patients with metastatic melanoma, The New England Journal of Medicine, 363(8):711-723 (2010).
Hoffman, D. et al., The less harmful cigarette: a controversial issue. a tribute to Ernst L. Wynder, Chemical Research in Toxicology, 14(7):767-790 (2001).
Imielinski, M. et al., Mapping the hallmarks of lung adenocarcinoma with massively parallel sequencing, Cell, 150(6):1107-1120 (2012).
International Search Report for PCT/US2015/062208, 4 pages (dated Jun. 2, 2016).
Koboldt, D. et al., VarScan 2: somatic mutation and copy number alteration discovery in cancer by exome sequencing, Genome Res., 22:568-576 (2012).
Kreiter, S. et al, Mutant MHC class II epitopes drive therapeutic immune response to cancer, Nature, 520(7549): 692-696 and Erratum (2015).
Kumar, P. et al., Predicting the effects of coding non-synonymous variants on protein function using the SIFT algorithm, Nat. Protoc., 4(8):1073-1081 (2009).
Larson, D. et al., SomaticSniper: identification of somatic point mutations in whole genome sequencing data, Bioinformatics, 28(3):311-317 (2012).
Lawrence, M. et al., Mutational heterogeneity in cancer and the search for new cancer-associated genes, Nature, 499:214-218 (2013).
Li, H. & Durbin, R., Fast and accurate short read alignment with Burrows-Wheeler transform, Bioinformatics, 25(14):1754-1760 (2009).
Linnemann, C. et al., High-throughput epitope discovery reveals frequent recognition of neoantigens by CD4+ T cells in human melanoma, Nat Med., 21(1):81-85 (2015).
Liu, C. et al., ATHLATES: accurate typing of human leukocyte antigen through exome sequencing, Nucleic Acids Research, 41(14):e142 (2013).
Liu, X. et al., dbNSFP v2.0: a database of human non-synonymous SNVs and their functional predictions and annotations, Human Mutation, 34(9):E2393-2402 (2013).
Lundegaard, C. et al., Accurate approximation method for prediction of class I MHC affinities for peptides of length 8, 10 and 11 using prediction tools trained on 9mers, Bioinformatics, 24(11):1397-1398 (2008).
Lundegaard, C. et al., NetMHC-3.0: accurate web accessible predictions of human, mouse and monkey MHC class I affinities for peptides of length 8-11, Nucleic Acids Research, 36:W509-512 (2008).
Matsushita, H. et al., Cancer exome analysis reveals a T-cell-dependent mechanism of cancer immunoediting, Nature, 482(7385):400-404 (2012).
Matsutake, T. & Srivastava, P., The immunoprotective MHC II epitope of a chemically induced tumor harbors a unique mutation in a ribosomal protein, Proceedings of the National Academy of Sciences of the United States of America, 98(7):3992-3997 (2001).
Nielsen, M. et al., Improved prediction of MHC class I and class II epitopes using a novel Gibbs sampling approach, Bioinformatics, 20(9):1388-1397 (2004).
Nielsen, M. et al., Reliable prediction of T-cell epitopes using neural networks with novel sequence representations, Protein Science, 12:1007-1017 (2003).
Nielsen, M. et al., The role of the proteasome in generating cytotoxic T-cell epitopes: insights obtained from improved predictions of proteasomal cleavage, Immunogenetics, 57:33-41 (2005).
Palles, C. et al., Germline mutations affecting the proofreading domains of POLE and POLD1 predispose to colorectal adenomas and carcinomas, Nature Genetics, 45(2):136-144 (2013).
Pfeifer, G. et al., Mutations induced by ultraviolet light, Mutation Research, 571:19-31 (2005).
Pfeifer, G. et al., Tobacco smoke carcinogens, DNA damage and p53 mutations in smoking-associated cancers, Oncogene, 21:7435-7451 (2002).
Philippidis, A., Merck Melanoma Drug is First PD-1 Inhibitor OK'd by FDA, Genetic Engineering & Biotechnology News, 3 pages (2014).
Powles, T. et al., MPDL3280A (anti-PD-L1) treatment leads to clinical activity in metastatic bladder cancer, Nature, 515:558-562 (2014).
Raedler, L. A., Keytruda (Pembrolizumab): First PD-1 Inhibitor Approved for Previously Treated Unresectable or Metastatic Melanoma, AMerican Health & Drug Benefits, 8(Special Feature): 96-100 (2015).
Rajasagi, M. et al., Systematic identification of personal tumor-specific neoantigens in chronic lymphocytic leukemia, Blood, 124(3):453-462 (2014).
Rizvi, N. A. et al, Supplementary Materials for Mutational lanscape determines sensitivity to PD-1 blockade in non-small cell lung cancer, Science, 1-31 (2015).
Rizvi, N.A., et al., Mutational landscape determines sensitivity to PD-1 blockade in non-small cell lung cancer, Science, 348(6230):124-128 (2015).
Robbins, P. et al., Mining exomic sequencing data to identify mutated antigens recognized by adoptively transferred tumor-reactive T cells, Nature Medicine, 19:747-752 (2013).
Robert, C. et al., Anti-programmed-death-receptor-1 treatment with pembrolizumab in ipilimumab-refractory advanced melanoma: a randomised dose-comparison cohort of a phase 1 trial, Lancet, 384:1109-1117 (2014).
Robinson, J. et al., Integrative genomics viewer, Nature Biotechnology, 29(1):24-26 (2011).
Rodenko, B. et al., Generation of peptide-MHC class I complexes through UV-mediated ligand exchange, Nature Protocols, 1(3):1120-1132 (2006).
Rooney, M. et al., Molecular and genetic properties of tumors associated with local immune cytolytic activity, Cell, 160(1-2):48-61 (2015).

(56) References Cited

OTHER PUBLICATIONS

Saunders, C. et al., Strelka: accurate somatic small-variant calling from sequenced tumor-normal sample pairs, Bioinformatics, 28(14):1811-1817 (2012).

Schreiber, R. et al., Cancer immunoediting: integrating immunity's roles in cancer suppression and promotion, Science, 331:1565-1570 (2011).

Schumacher, T. et al., A vaccine targeting mutant IDH1 induces antitumour immunity, Nature 512:324-327 (2014).

Sherry, S. et al., dbSNP-database for single nucleotide polymorphisms and other classes of minor genetic variation, Genome Research, 9:677-679 (1999).

Snyder, A. et al, Genetic Basis for Clinical Response to CTLA-4 Blockade in Melanoma, New England Journal of Medicine, 371(23): 2189-2199 (2014).

Taube, J. et al., Association of PD-1, PD-1 Ligands, and Other Features of the Tumor Immune Microenvironment with Response to Anti-PD-1 Therapy, Clinical Cancer Research, 20(19):5064-5074 (2014).

The Cancer Genome Atlas Research Network, Comprehensive molecular profiling of lung adenocarcinoma, Nature, 511(7511): 543-550 (2014).

Toebes, M. et al., Design and use of conditional MHC class I ligands, Nature Medicine, 12(2):246-251 (2006).

Topalian, S. et al., Safety, Activity, and Immune Correlates of Anti-PD-1 Antibody in Cancer, The New England Journal of Medicine, 366(26):2443-2454 (2012).

Tran, E. et al., Cancer immunotherapy based on mutation-specific CD4+ T cells in a patient with epithelial cancer, Science, 344:641-645 (2014).

Tumeh, P. et al., PD-1 blockade induces responses by inhibiting adaptive immune resistance, Nature, 515(7528):568-571 (2014).

Van Rooij, N. et al., Tumor exome analysis reveals neoantigen-specific T-cell reactivity in an ipilimumab-responsive melanoma, J Clin Oncol, 31(32):439-442 (2013).

Via, M., The 1000 Genomes Project: new opportunities for research and social challenges, Genome Medicine, 2:3 (2010).

Vogelstein, B. et al., Cancer genome landscapes, Science, 339(6127):1546-1558 (2013).

Wang, X. et al., Genomic instability and endoreduplication triggered by RAD17 deletion, Genes & Development, 17:965-970 (2003).

Wolchok, J. et al., Guidelines for the evaluation of immune therapy activity in solid tumors: immune-related response criteria, Clinical Cancer Research, 15(23):7412-7420 (2009).

Wolchok, J. et al., Nivolumab plus ipilimumab in advanced melanoma, The New England Journal of Medicine, 369(2):122-133 (2013).

Written Opinion for PCT/US2015/062208, 6 pages (dated Jun. 2, 2016).

Yadav, M. et al., Predicting immunogenic tumour mutations by combining mass spectrometry and exome sequencing, Nature, 515:572-576 (2014).

Yuan, J. et al., CTLA-4 blockade enhances polyfunctional NY-ESO-1 specific T cell responses in metastatic melanoma patients with clinical benefit, Proceedings of the National Academy of Sciences of the United States of America, 105(51):20410-20415 (2008).

Vareki, S. M., High and low mutational burden tumors versus immunologically hot and cold tumors and response to immune checkpoint inhibitors, Journal for ImmunoTherapy of Cancer, 6(1): 1-5 (2018).

* cited by examiner

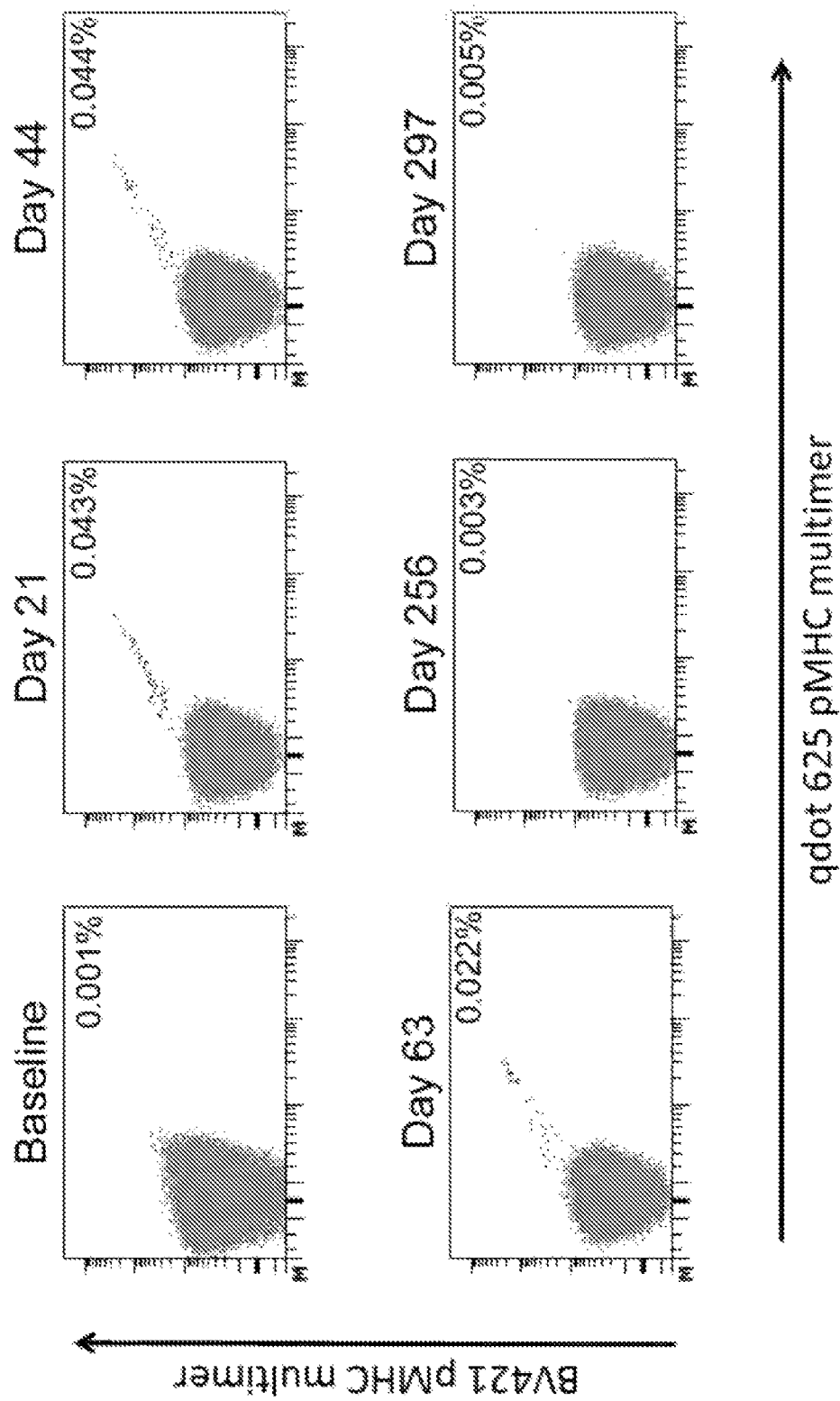

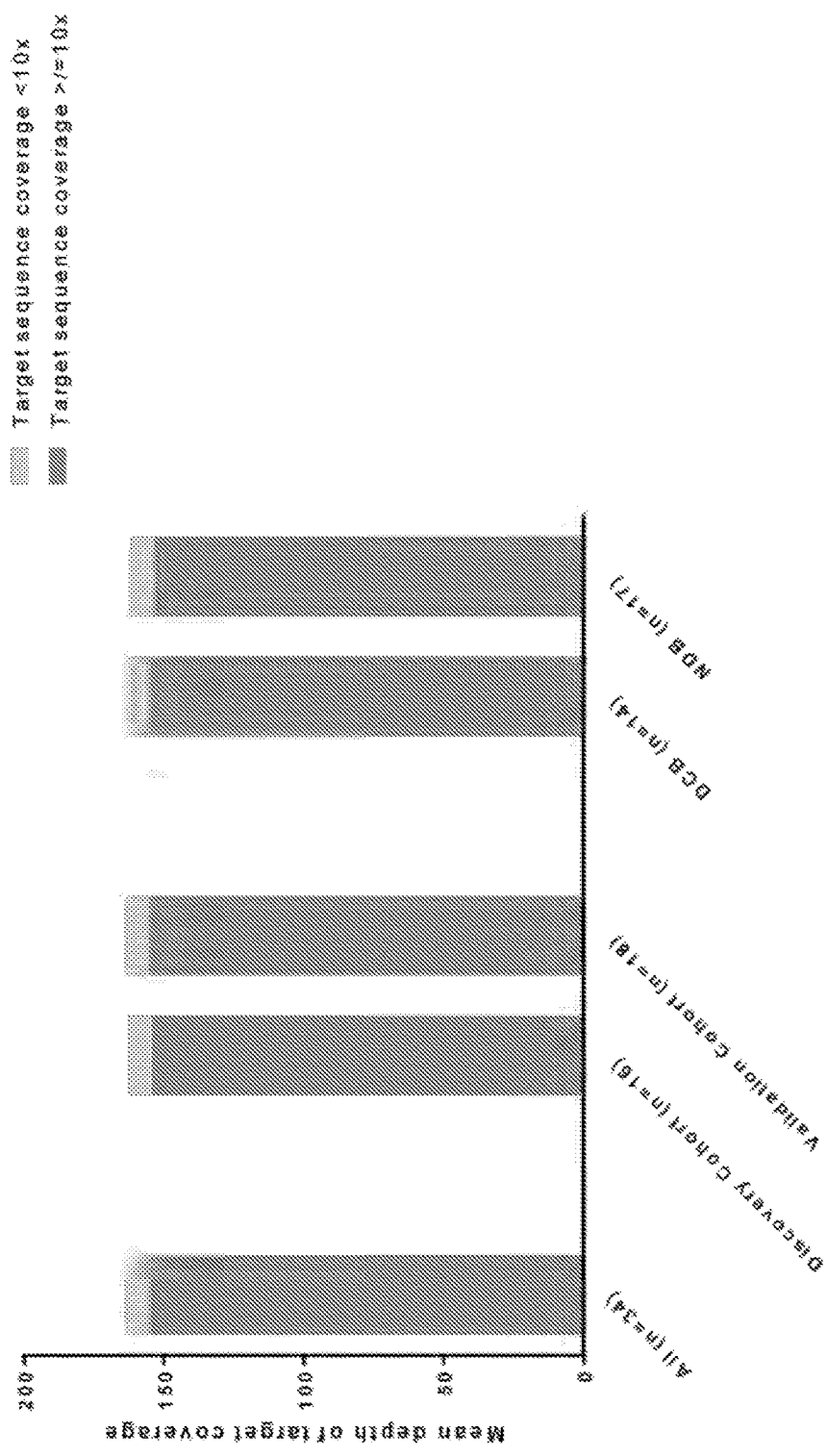
Figure 5: Coverage and depth of target exome sequence. Coverage and depth of sequenced exomes is similar in discovery compared to validation cohorts and is similar in those with durable clinical benefit (DCB) compared to those with no durable benefit (NDB).

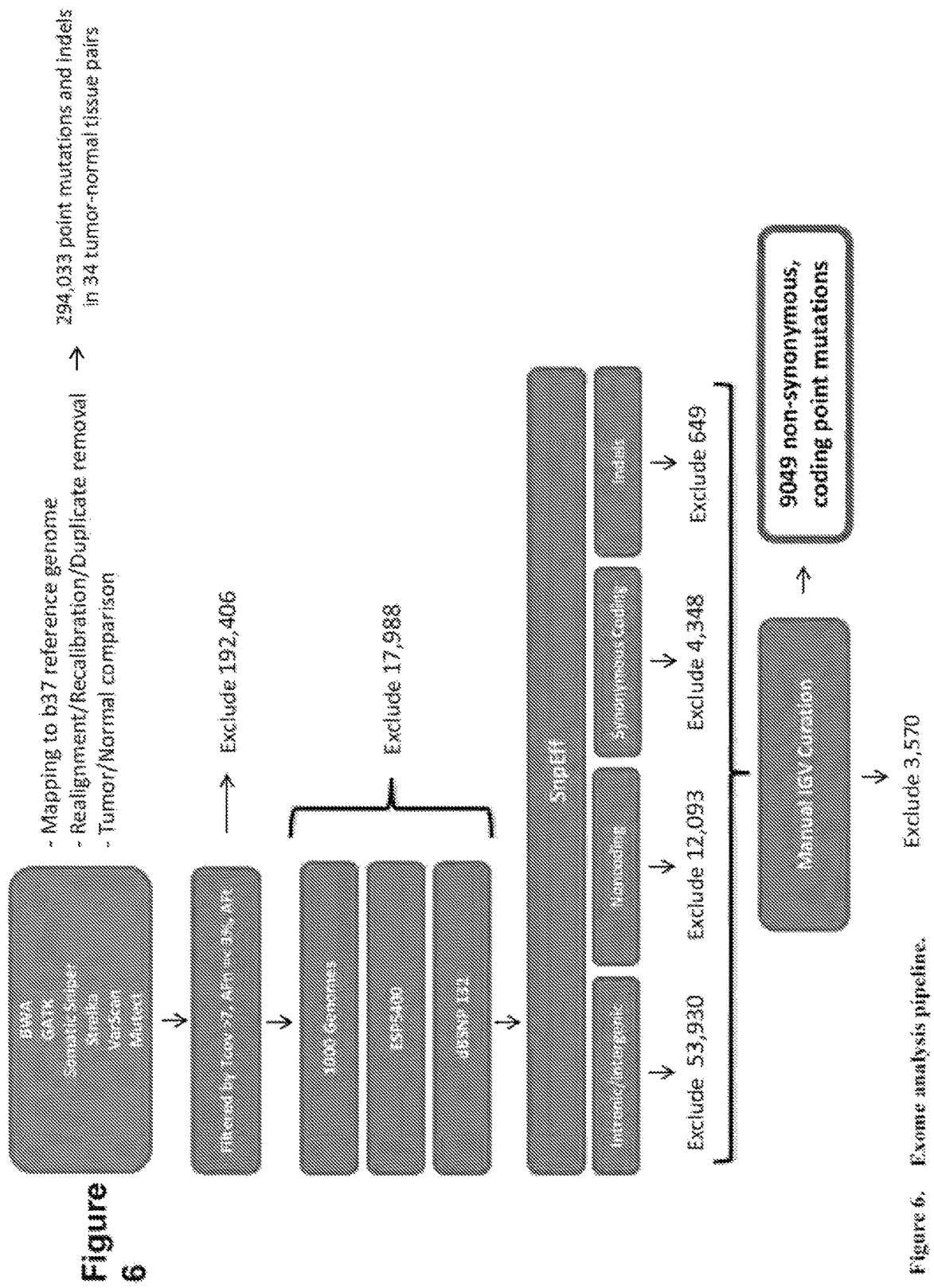
Figure 6. Exome analysis pipeline.

Figure 7A
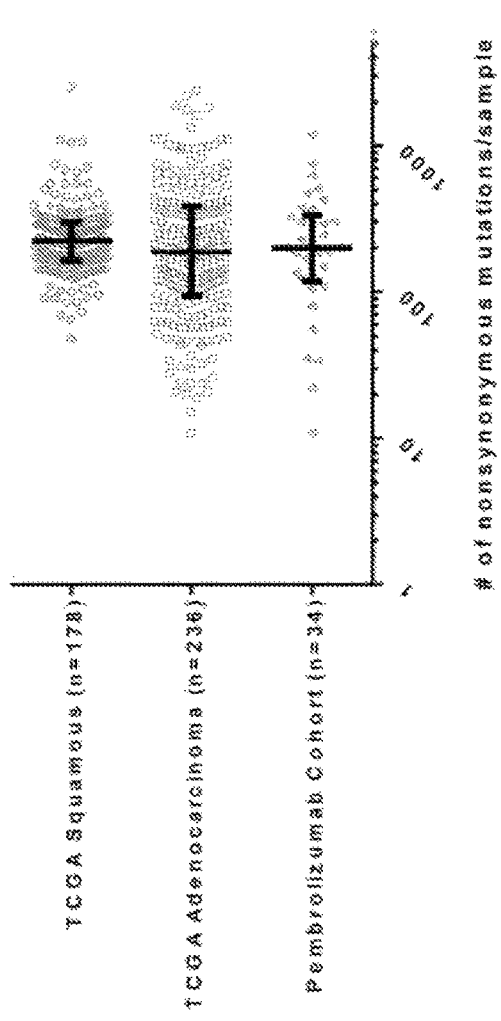
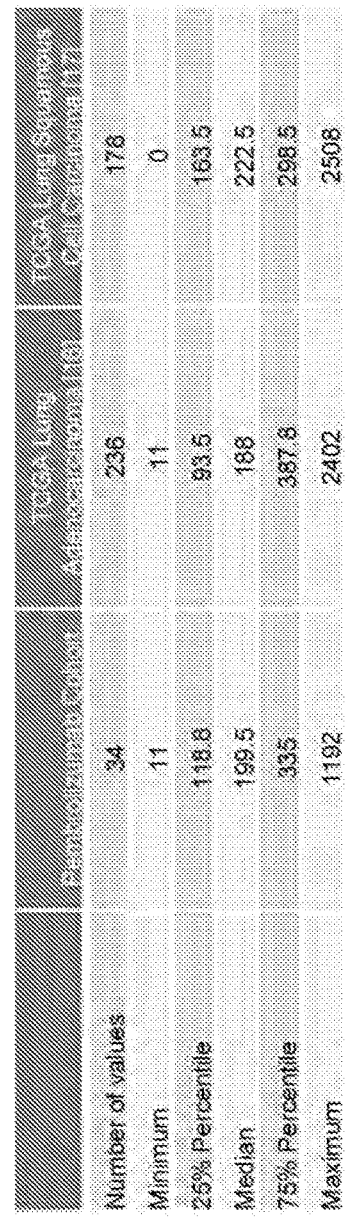
Figure 7A: Median and interquartile range of mutations in the current study and in published series of NSCLC (13,14). (A) Somatic nonsynonymous mutation burden.

Figure 7B: Median and interquartile range of mutations in the current study and in published series of NSCLC (13, 14). (B) Total exonic mutations.

Figure 8: Pattern of nucleotide changes in tumors sequenced. The spectrum and frequency of nucleotide changes in the pembrolizumab-treated NSCLCs is typical of non-small cell lung cancers.

Figure 9: Distribution of nucleotide alterations in nonsynonymous mutations. Across the overall set of sequenced NSCLCs treated with pembrolizumab, C>A transversions are more frequent in those with DCB, while C>T transitions are more frequent in those with NDB (* denotes p=0.01).

Figure 10. Neoantigen analysis pipeline. *All steps are executed for predicted wild type and mutant. *MHC Class I prediction by NetMHCv3.4

Figure 11: HLA type and benefit to pembrolizumab. There was no evident association between the presence of any specific HLA allele and benefit from pembrolizumab.

Figure 12: Neoantigens and best objective response. The absolute quantity of predicted neoantigens correlates with best overall response (Spearman ρ -0.43, 95% CI -0.68- -0.10, p=0.01), but the frequency of neoantigens/nonsynonymous mutation does not (Spearman ρ -0.04, 95% CI -0.39-0.30, p=0.78).

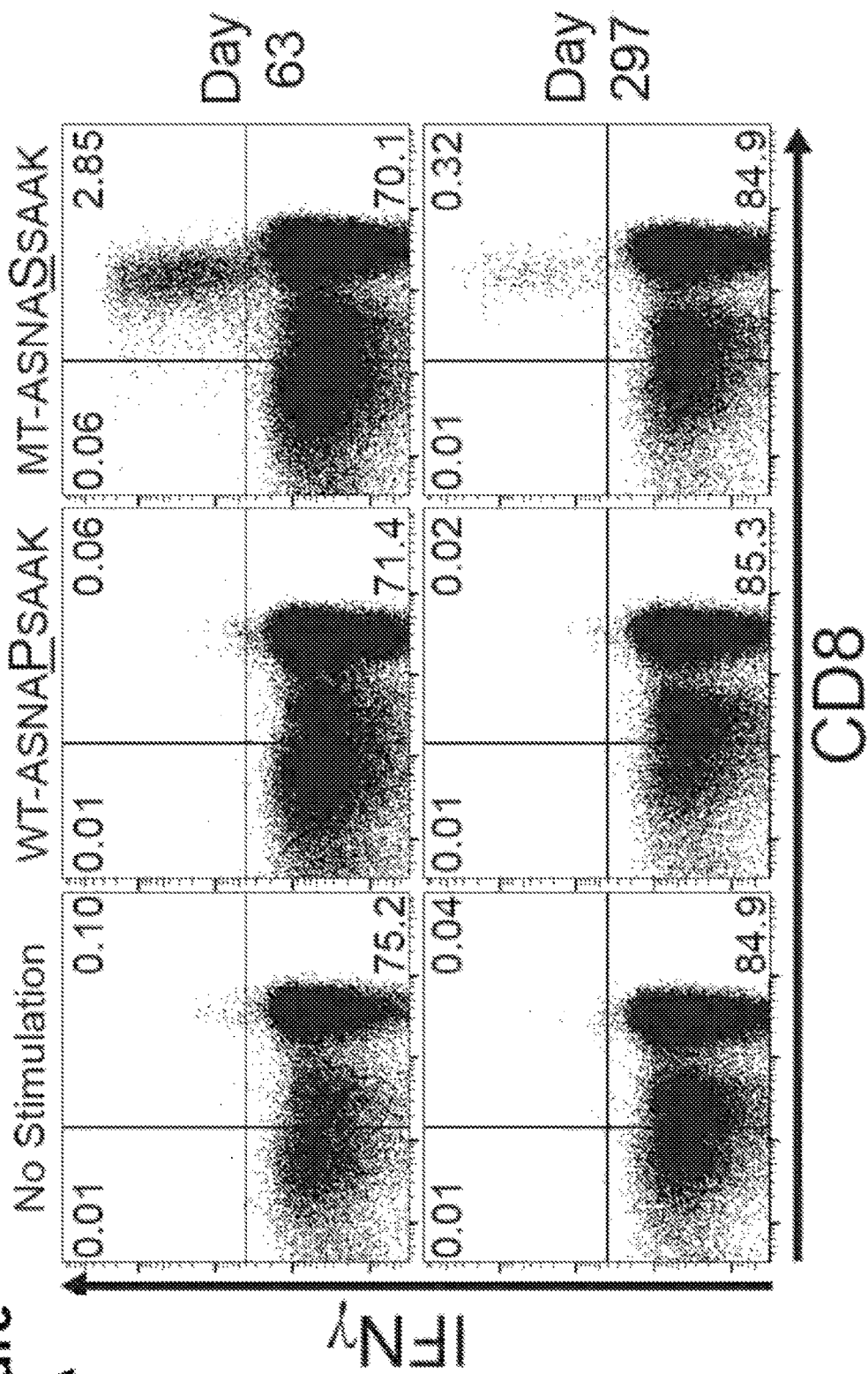
Figure 13A: Following expansion, stimulation of peripheral blood mononuclear cells with wild type or mutant peptide versus no stimulation control shows a polyfunctional CD8+ T cell response to the mutant peptide only. (A) Neoantigen-induced IFNγ production by CD3+CD8+ T-cells at day 63 and day 297 after initiation of therapy.

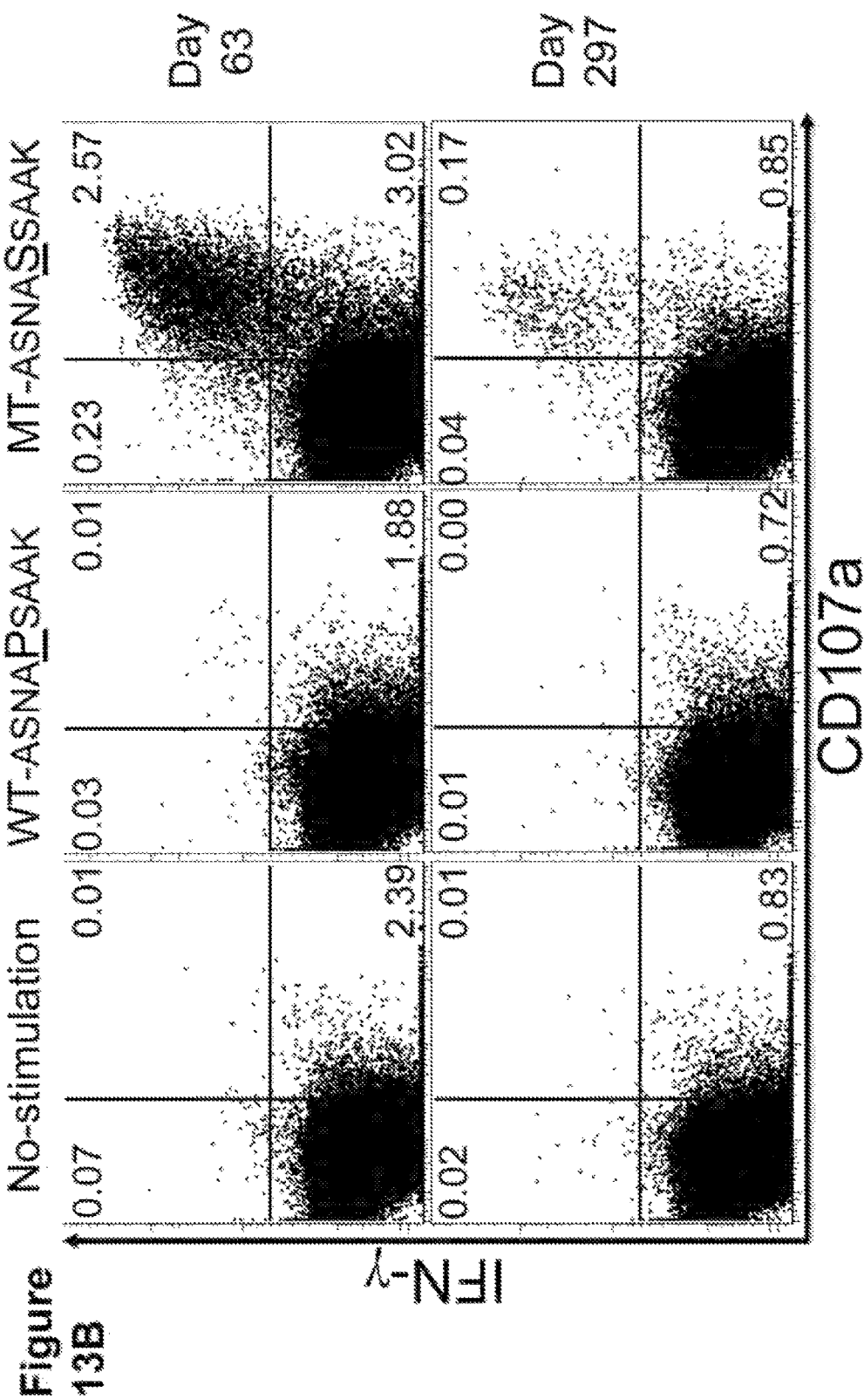
Figure 13B: Following expansion, stimulation of peripheral blood mononuclear cells with wild type or mutant peptide versus no stimulation control shows a polyfunctional CD8+ T cell response to the mutant peptide only. (B) Co-staining of CD107a in CD3+CD8+IFNγ+ cells when stimulated with mutant peptide versus no stimulation or wild type.

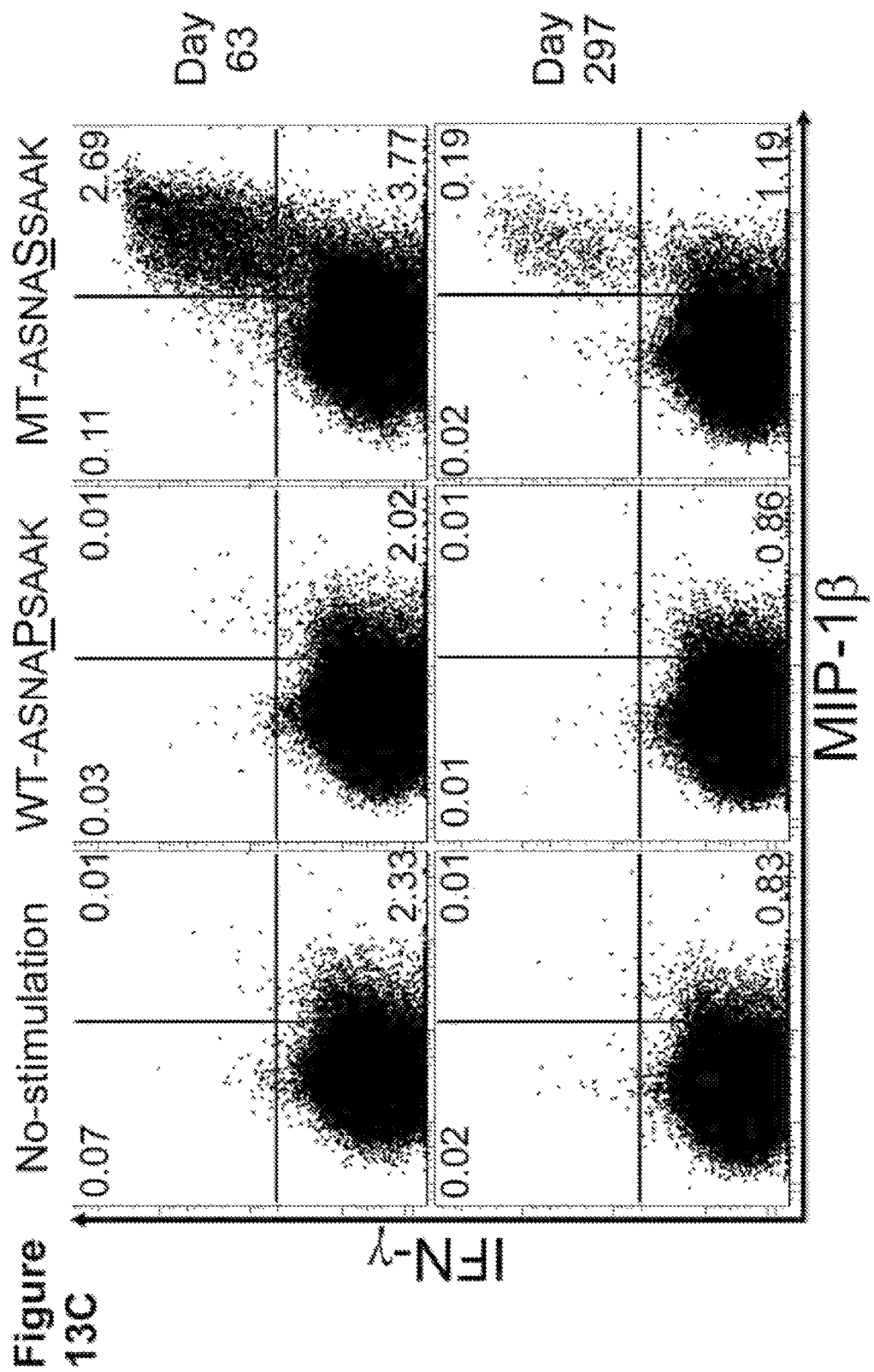
Figure 13C: Following expansion, stimulation of peripheral blood mononuclear cells with wild type or mutant peptide versus no stimulation control shows a polyfunctional CD8+ T cell response to the mutant peptide only. (C) Co-staining of MIP-1β in CD3+CD8+IFNγ+ cells when stimulated with mutant peptide versus no stimulation or wild type.

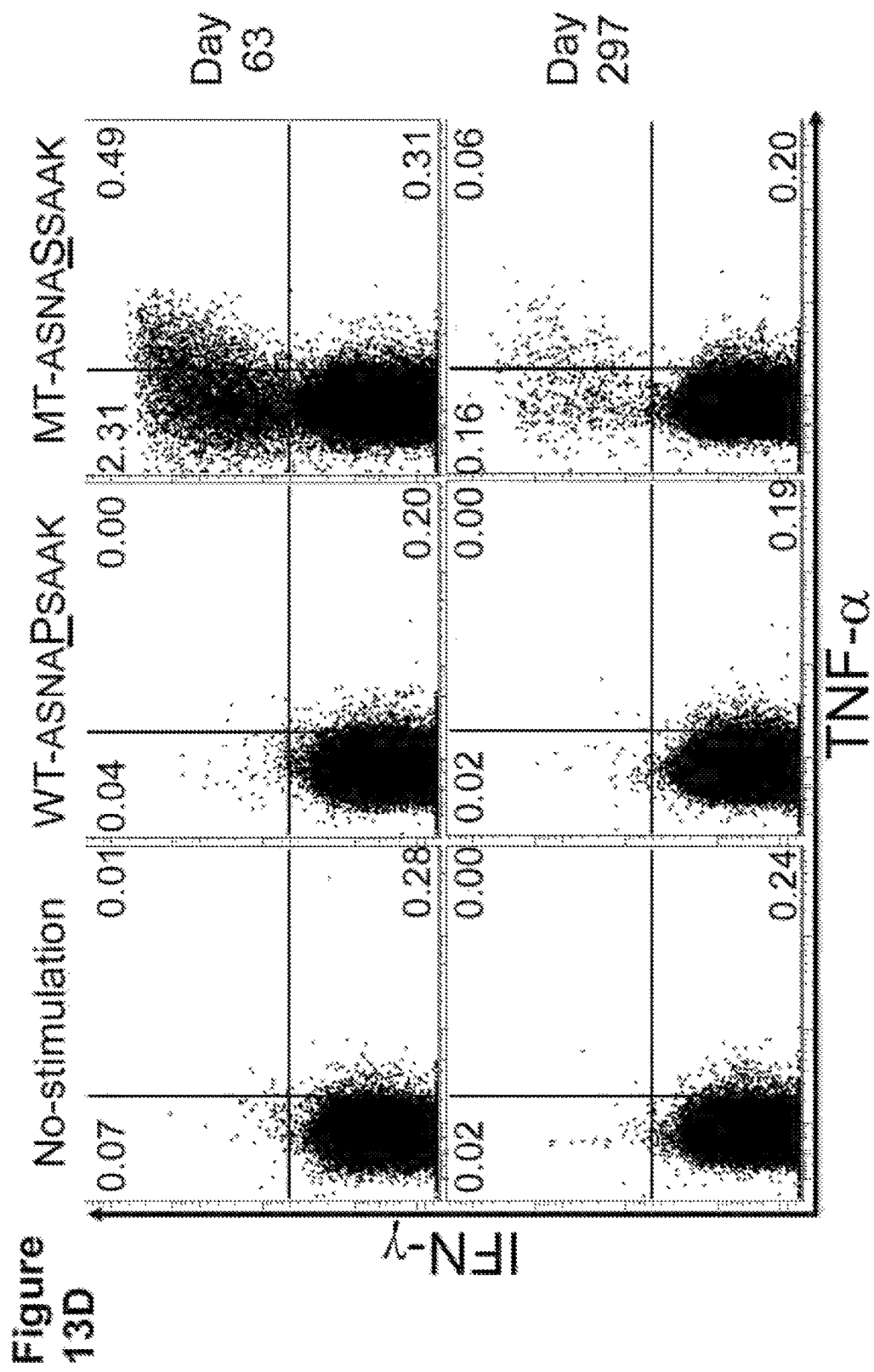
Figure 13D: Following expansion, stimulation of peripheral blood mononuclear cells with wild type or mutant peptide versus no stimulation control shows a polyfunctional CD8+ T cell response to the mutant peptide only. (D) Co-staining of TNF-α in CD3+CD8+IFNγ++ cells when stimulated with mutant peptide versus no stimulation or wild type.

Figure 14A
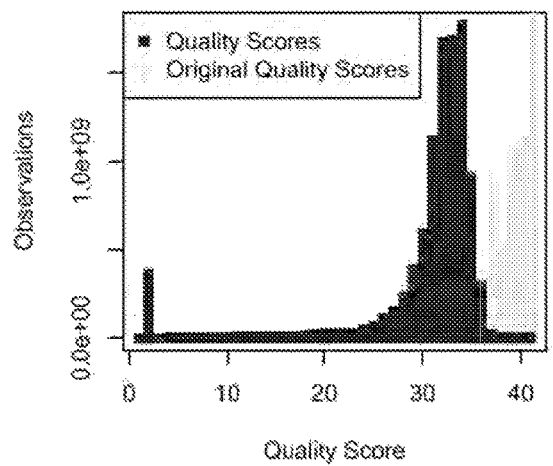
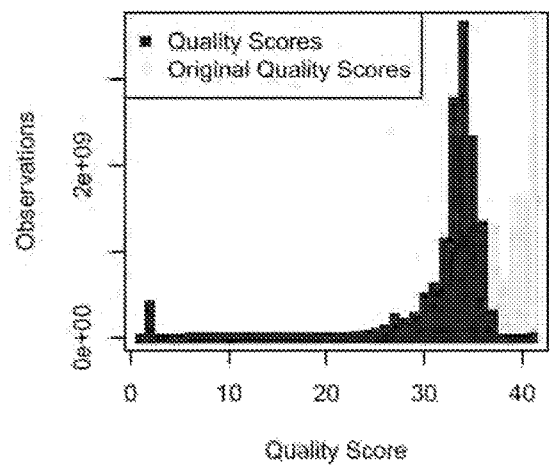
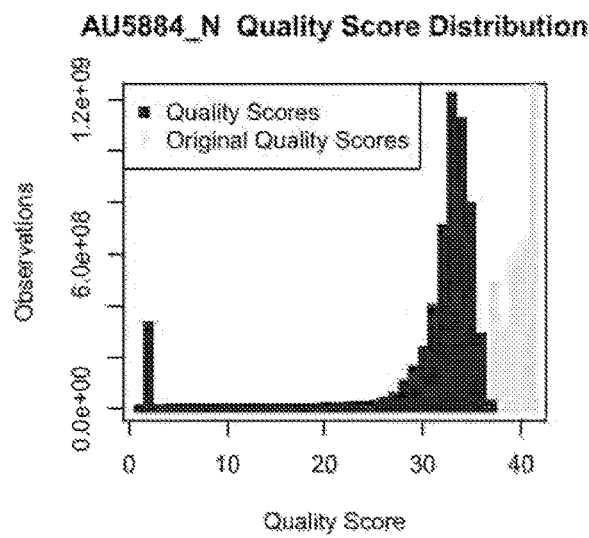
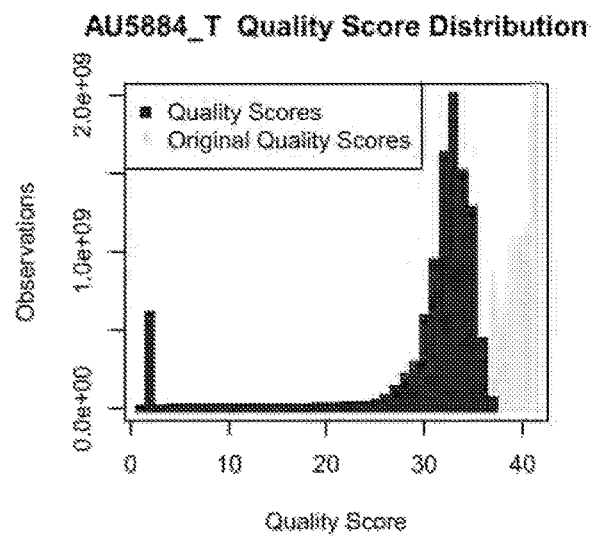

Figure 14B
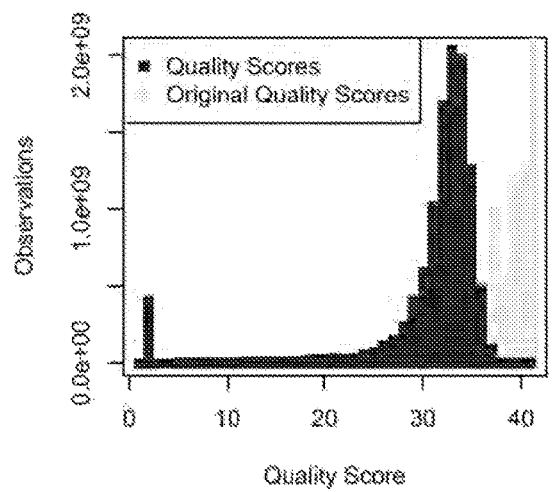
BL3403_N Quality Score Distribution
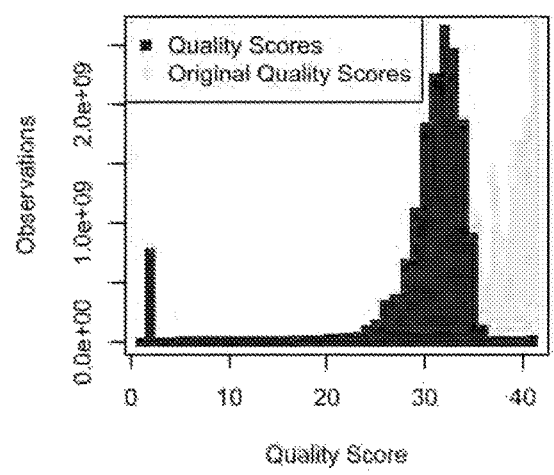
BL3403_T Quality Score Distribution
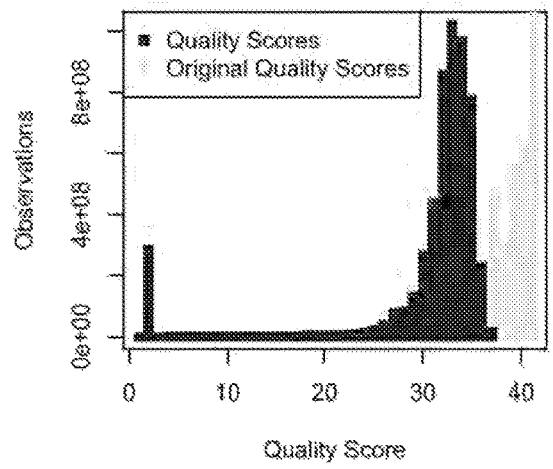
CA9903_N Quality Score Distribution
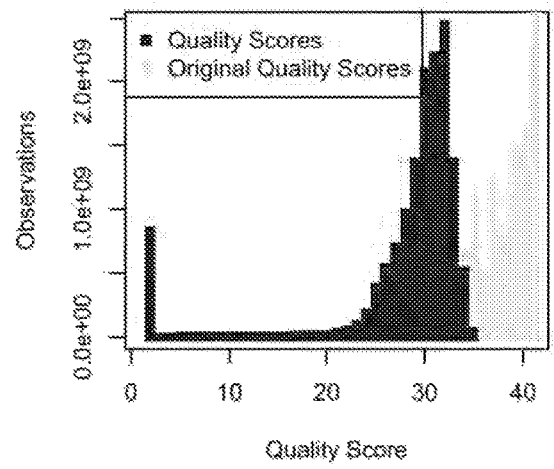
CA9903_T Quality Score Distribution Figure 14C
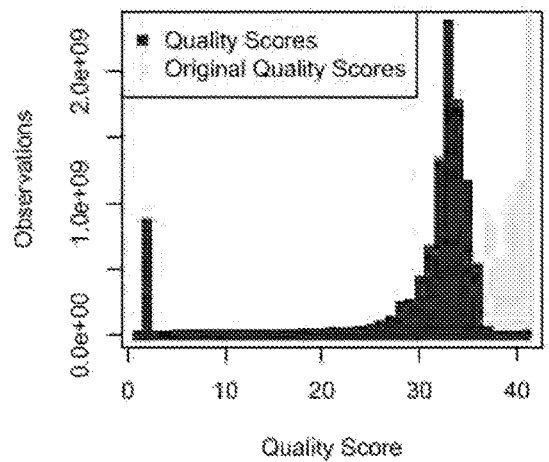
CU9061_N Quality Score Distribution
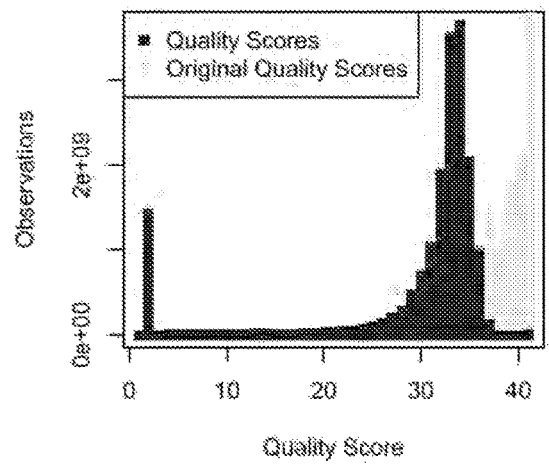
CU9061_T Quality Score Distribution
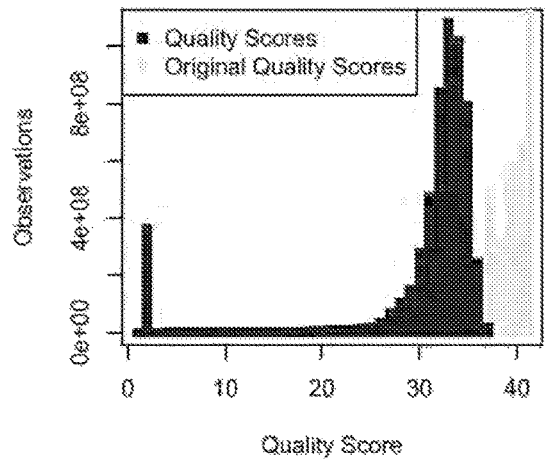
DI6359_N Quality Score Distribution
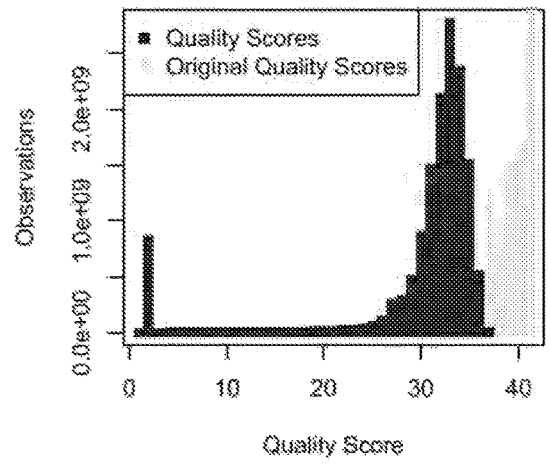
DI6359_T Quality Score Distribution

Figure 14D
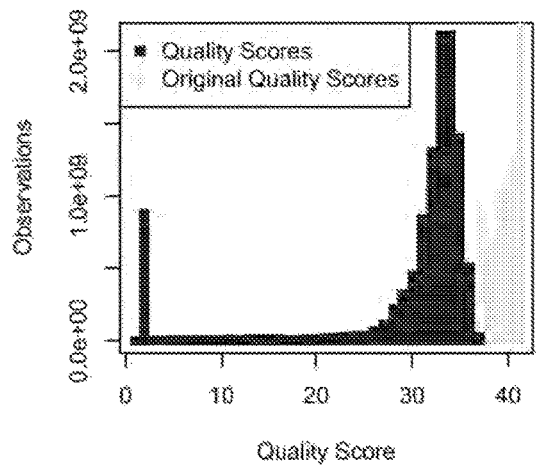
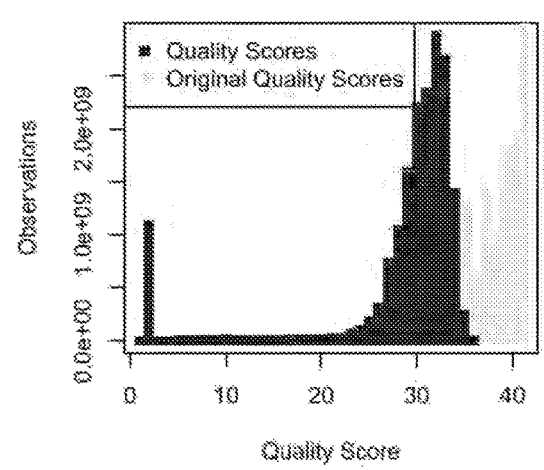
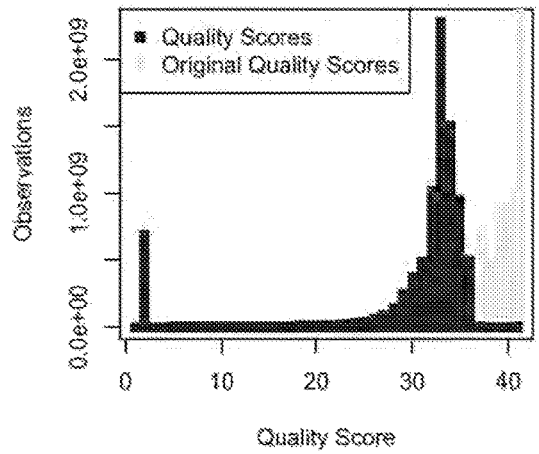
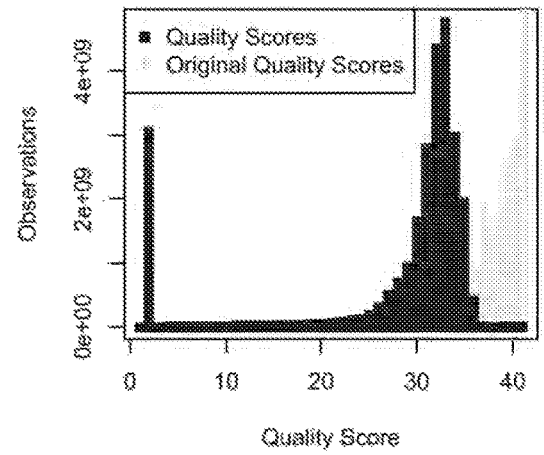

Figure 14E
GR0134_N Quality Score Distribution
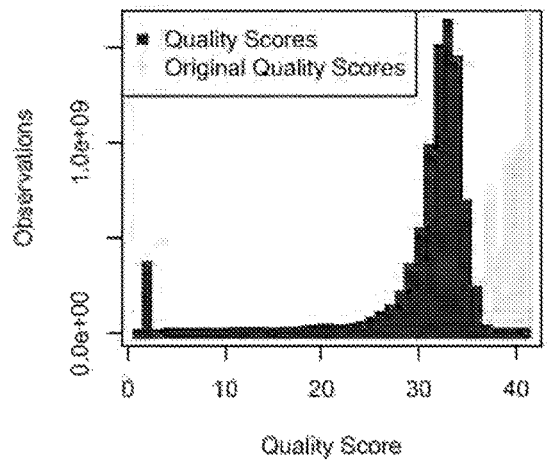
GR0134_T Quality Score Distribution
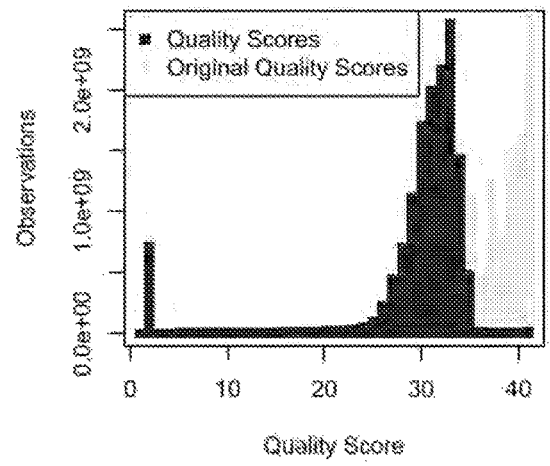
GR4788_N Quality Score Distribution
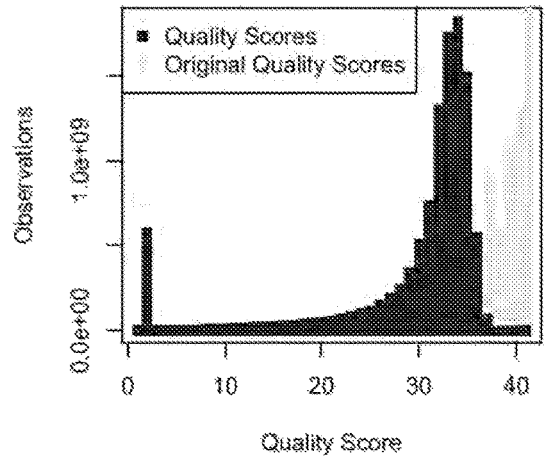
GR4788_T Quality Score Distribution
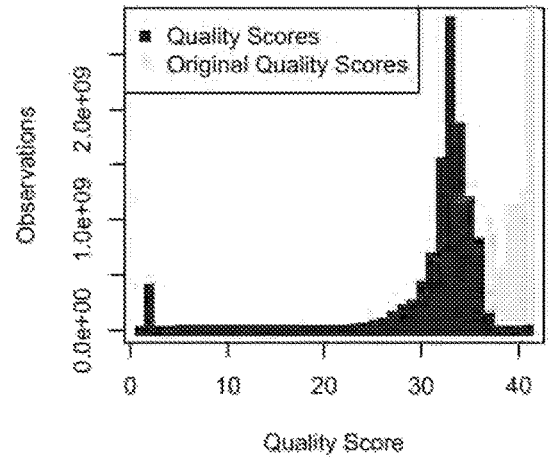

Figure 14F
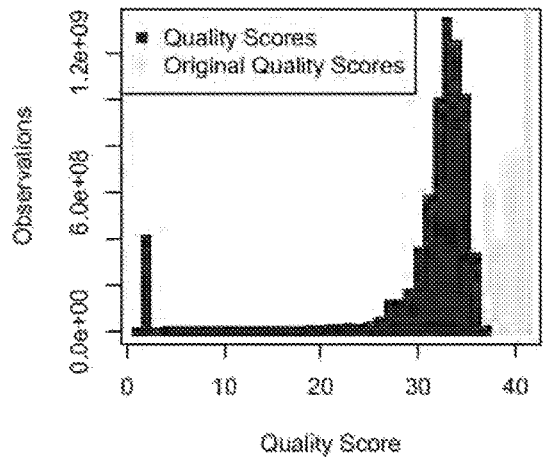
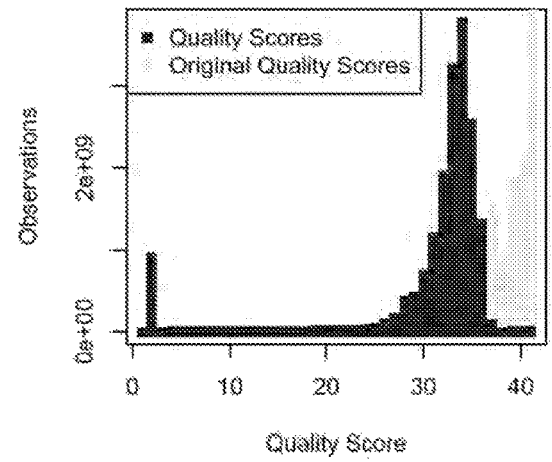
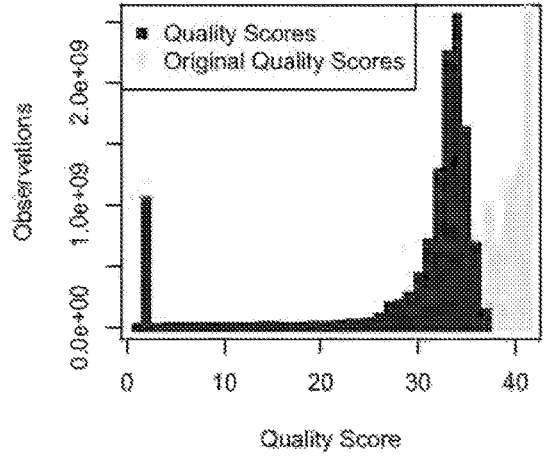
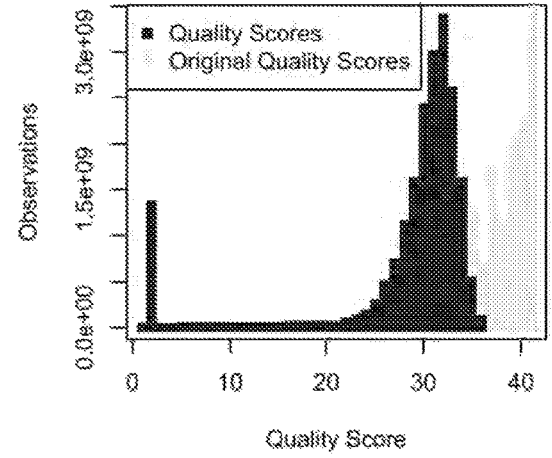

Figure 14G
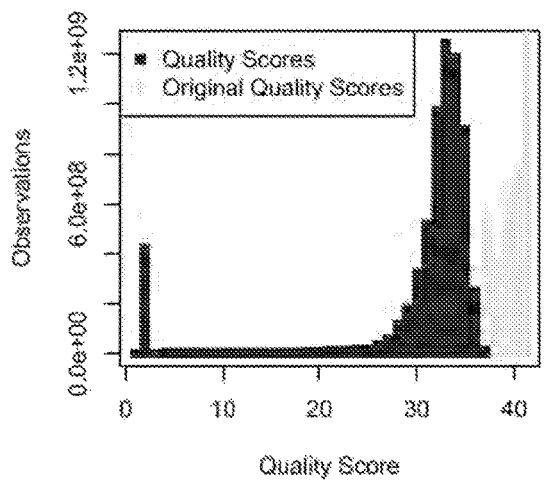
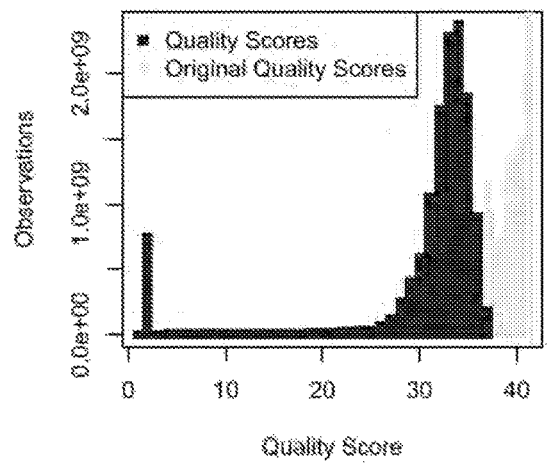
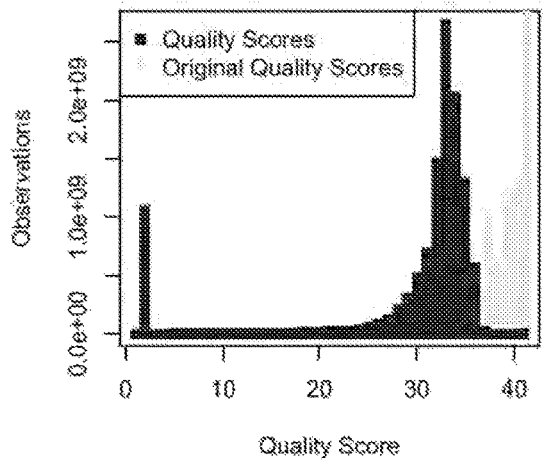
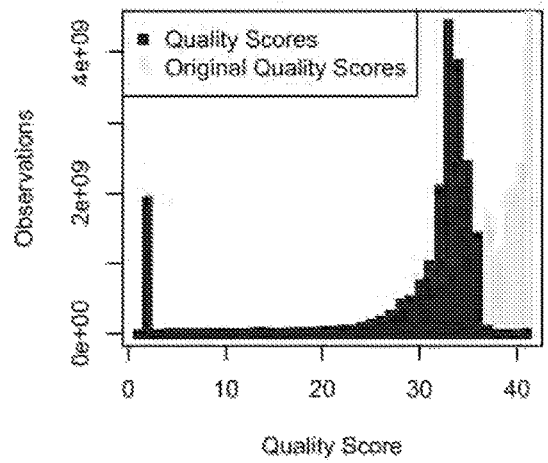

Figure 14H
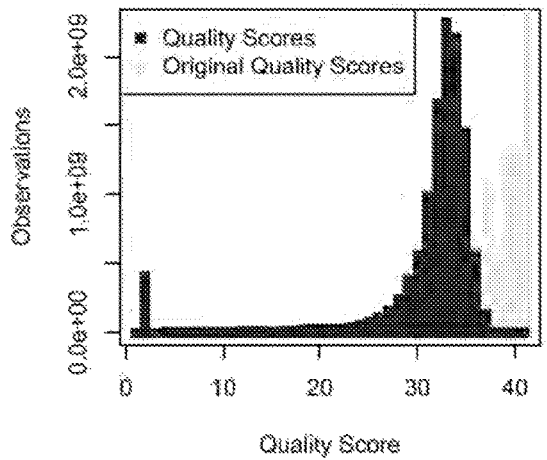
LO5004_N Quality Score Distribution
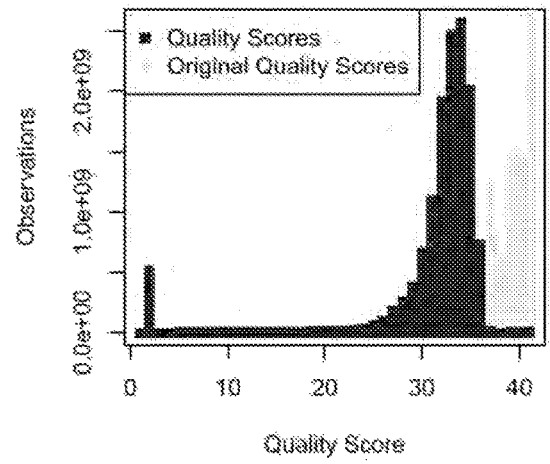
LO5004_T Quality Score Distribution
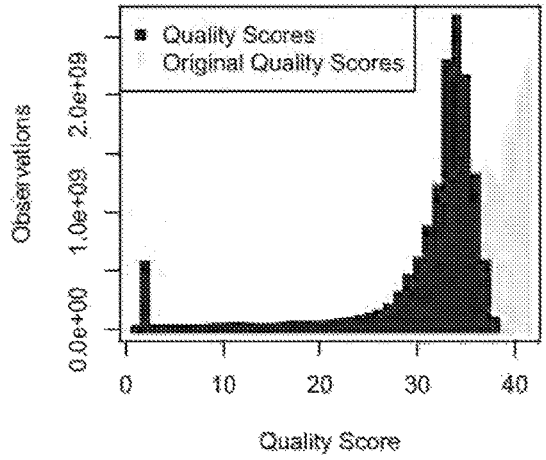
M4945_N Quality Score Distribution
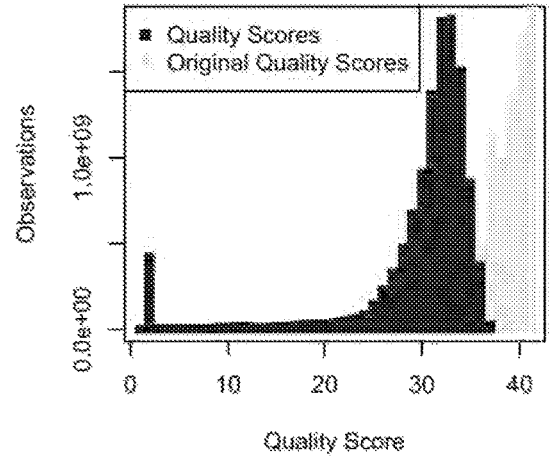
M4945_T Quality Score Distribution Figure 14I
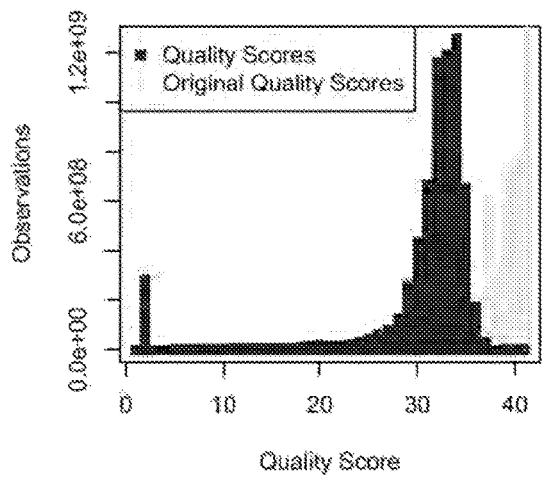
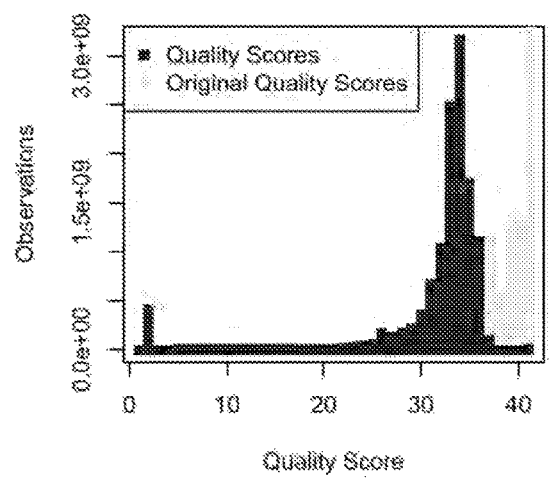
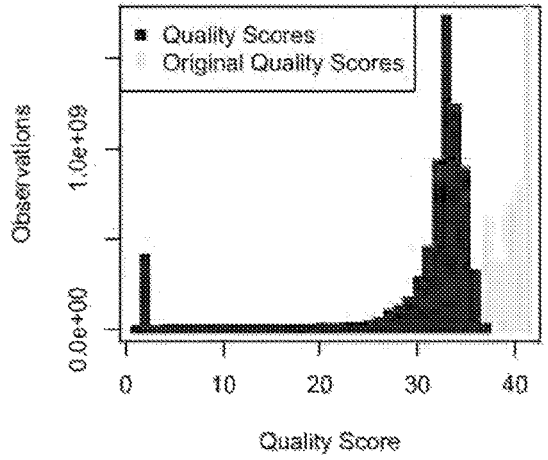
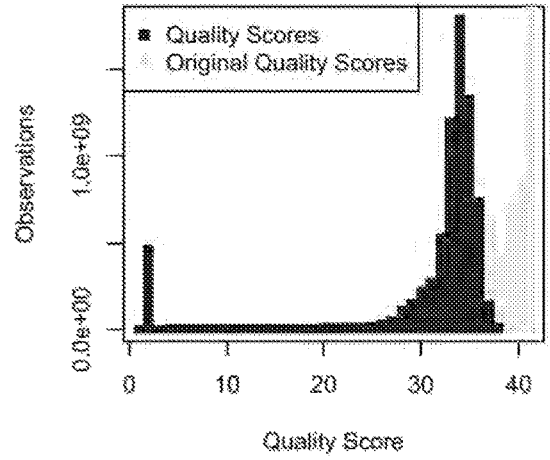

Figure 14J
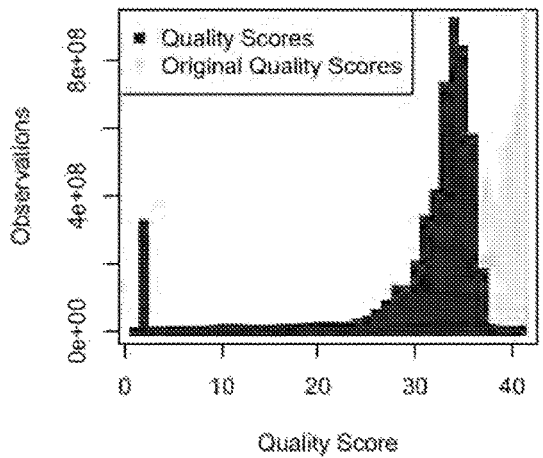
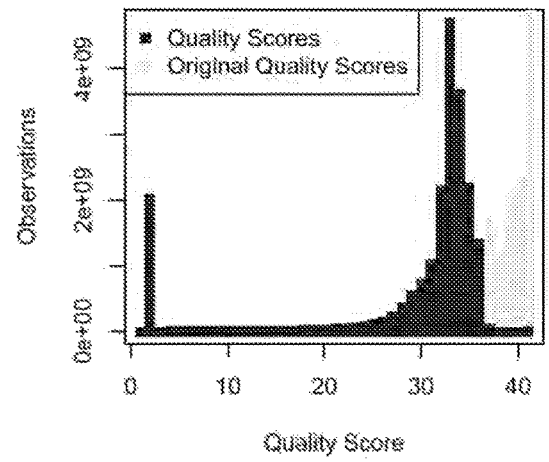
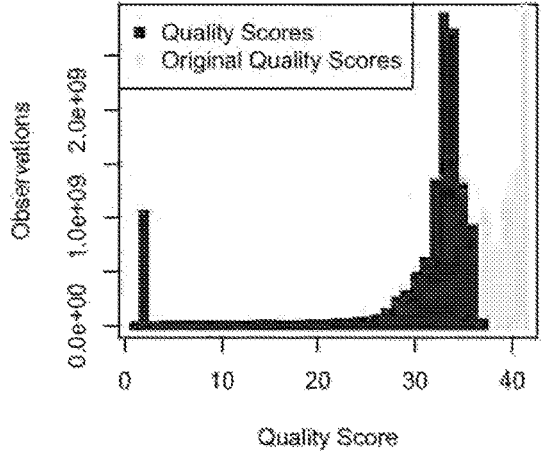
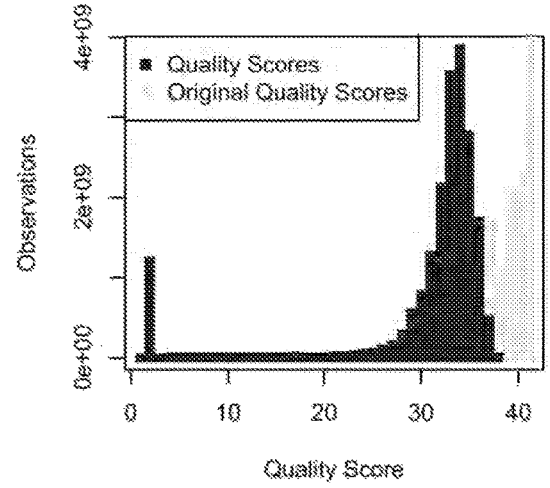

Figure 14K
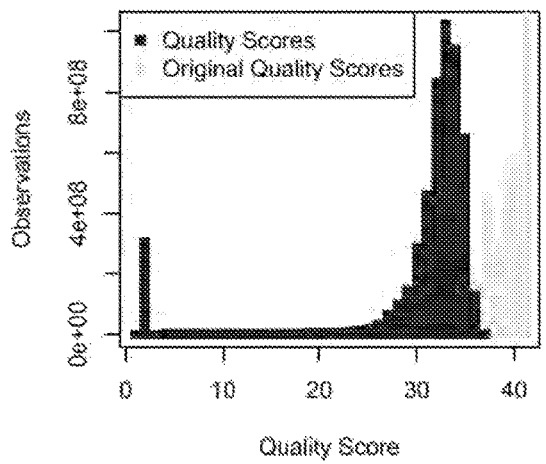
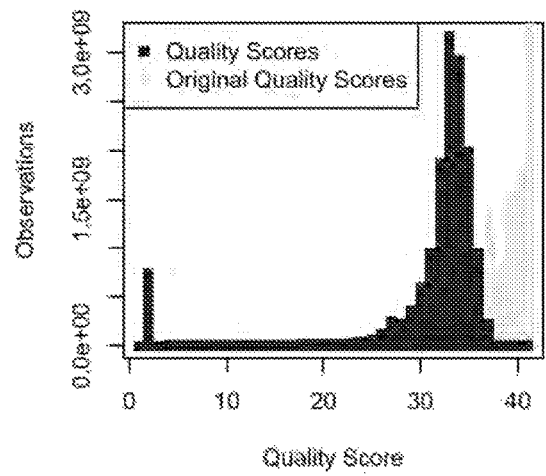
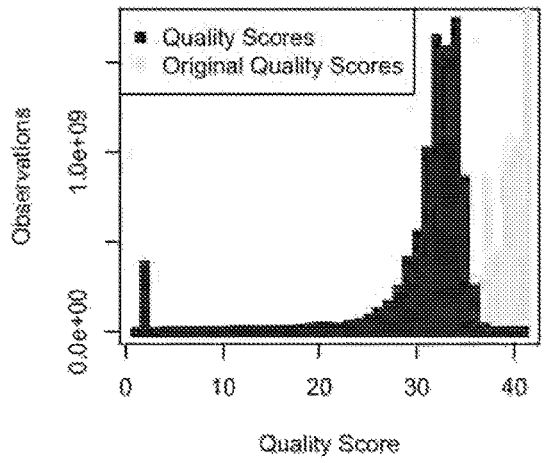
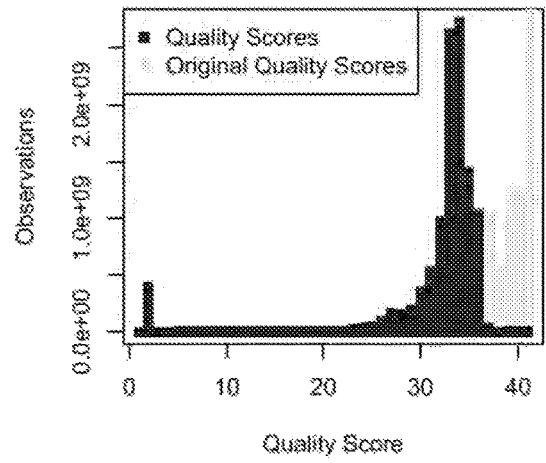

Figure 14L
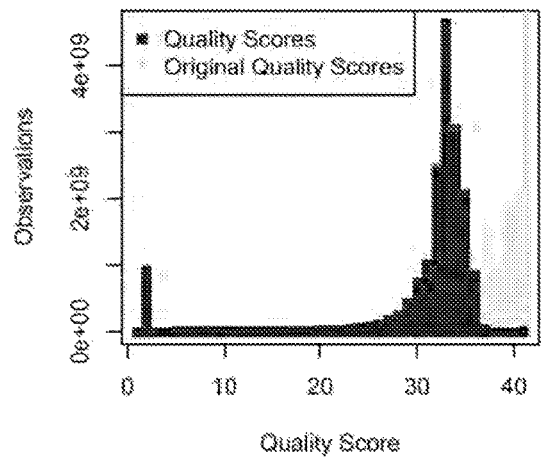
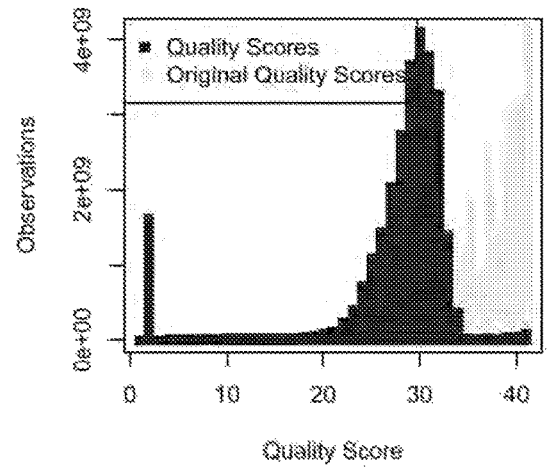
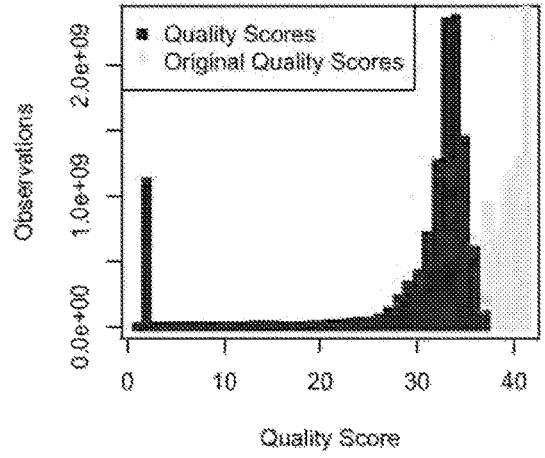
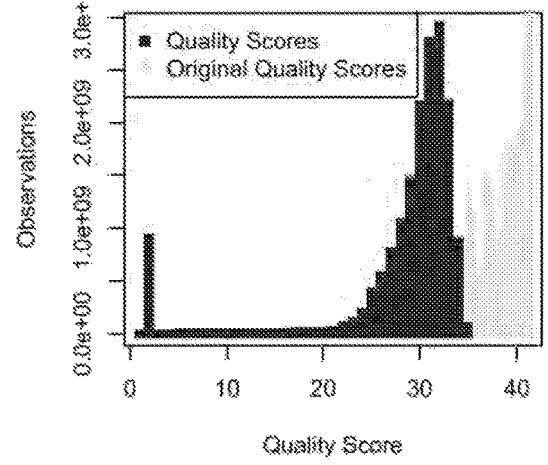

Figure 14M
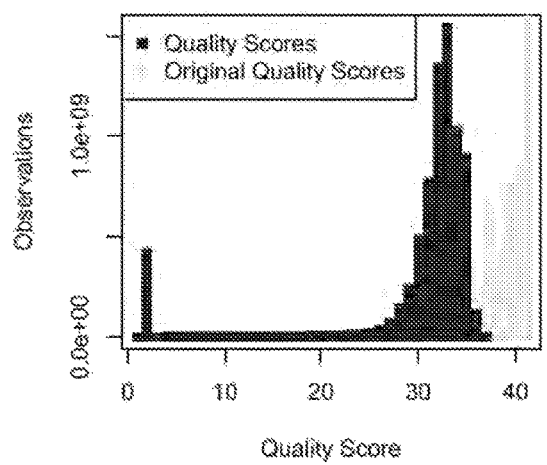
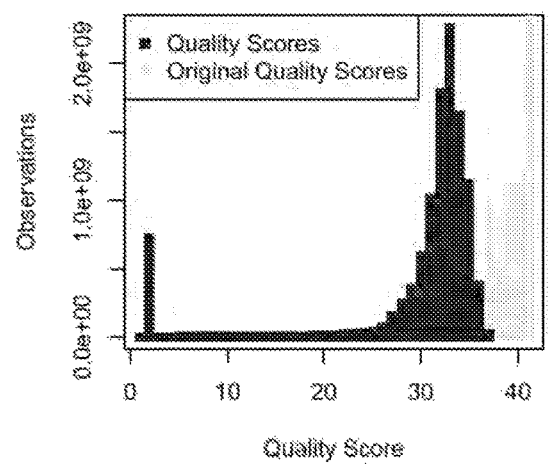
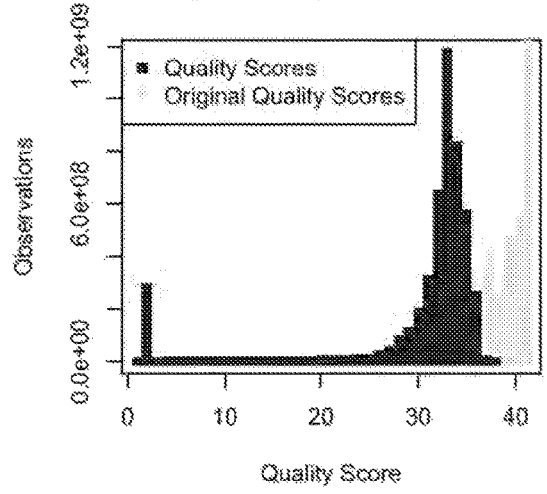
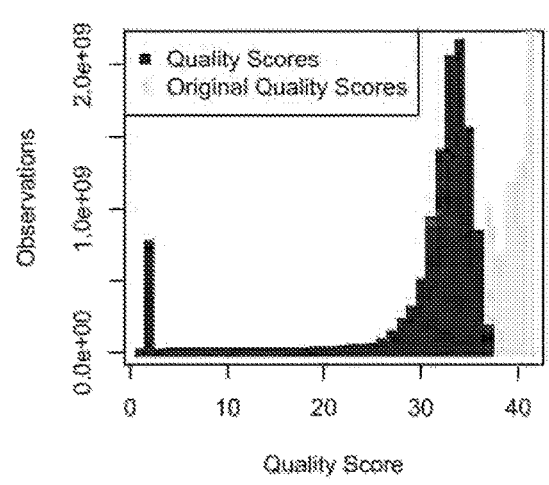

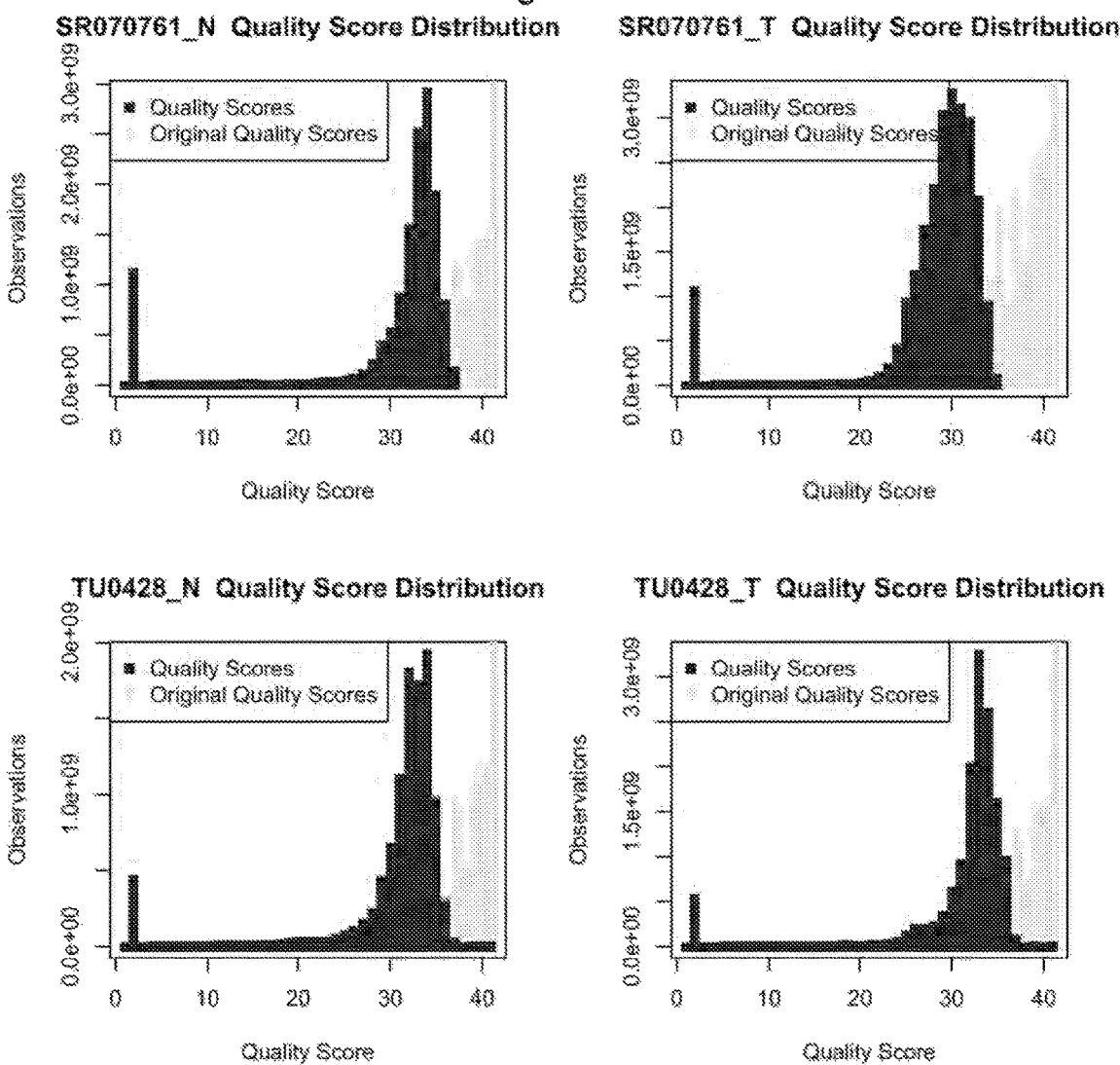

Figure 14O
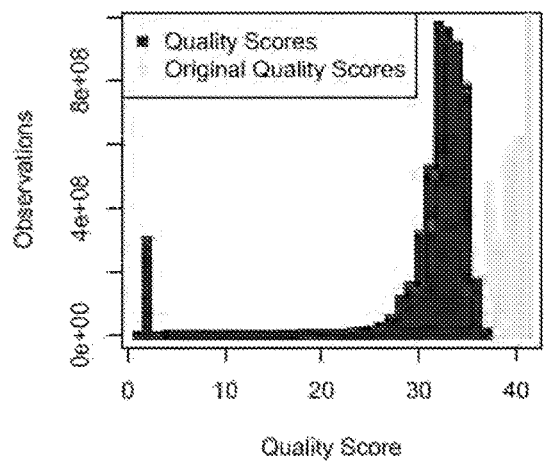
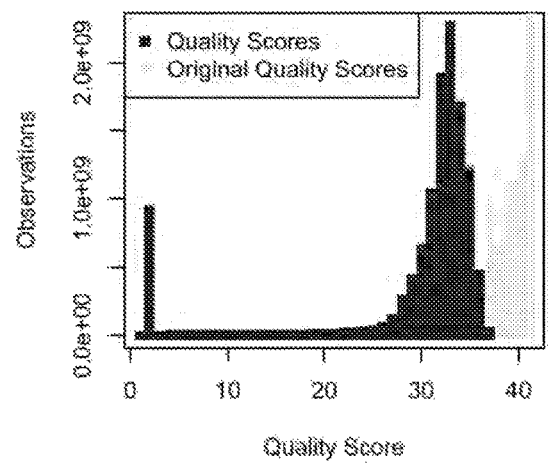
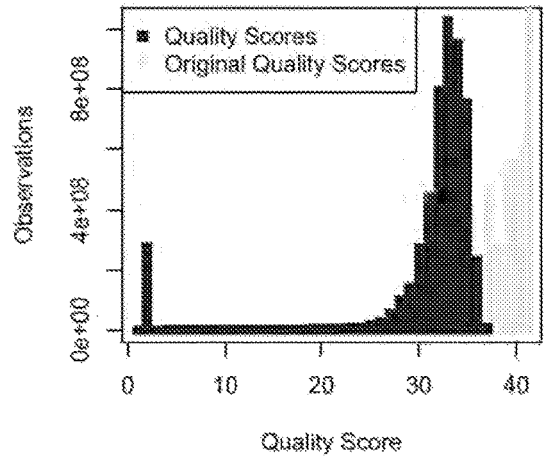
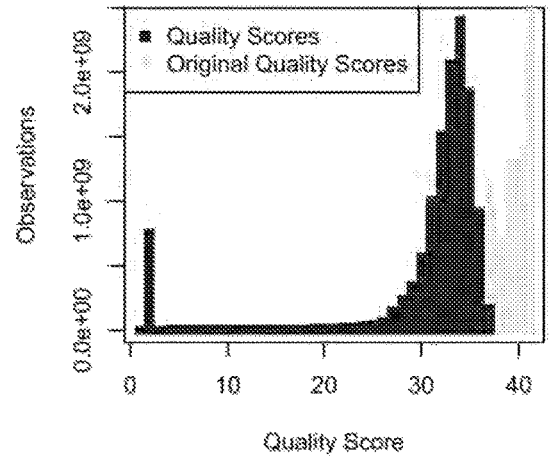

Figure 14P
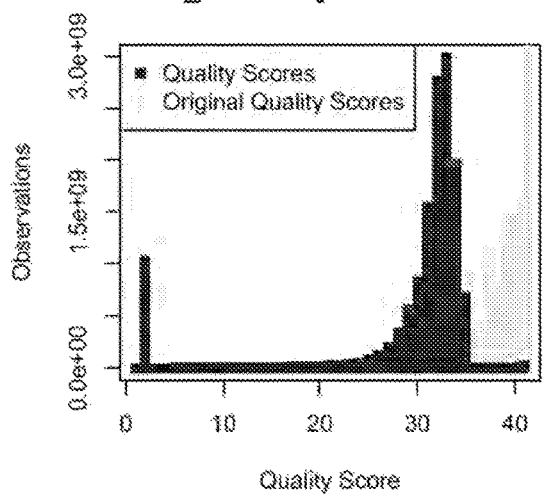
WA7899_N Quality Score Distribution
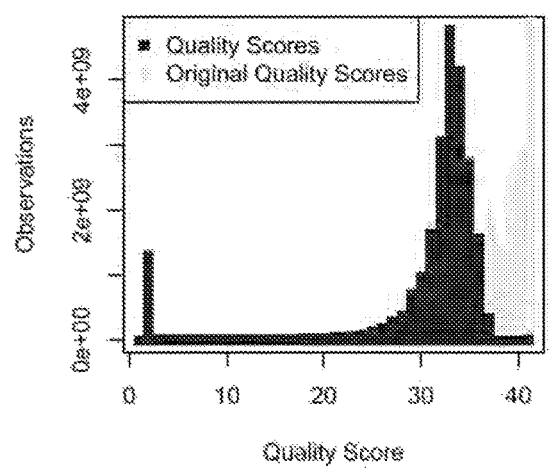
WA7899_T Quality Score Distribution
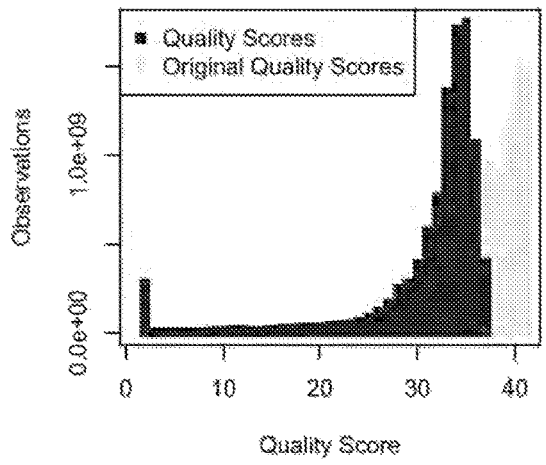
Y2087_N Quality Score Distribution
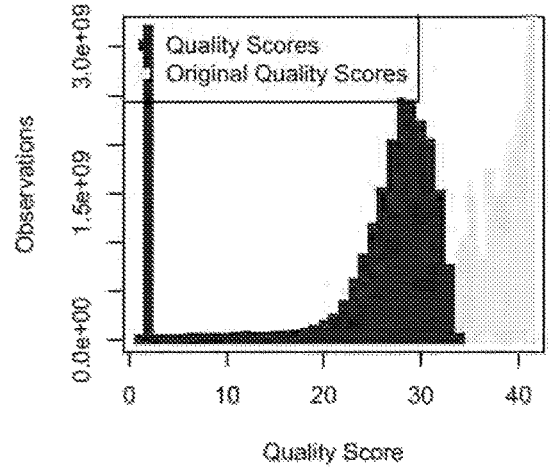
Y2087_T Quality Score Distribution

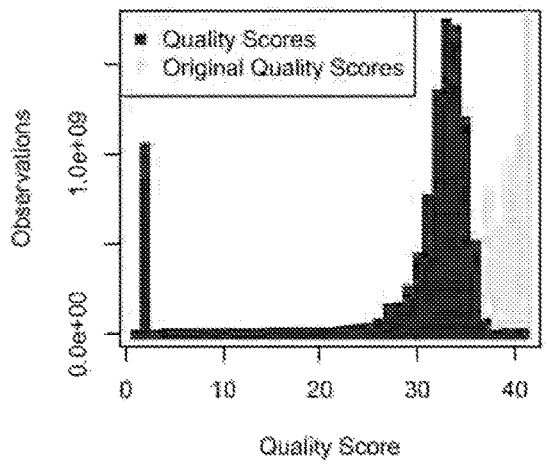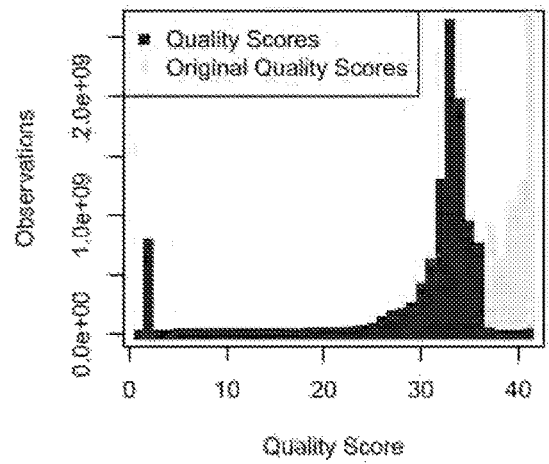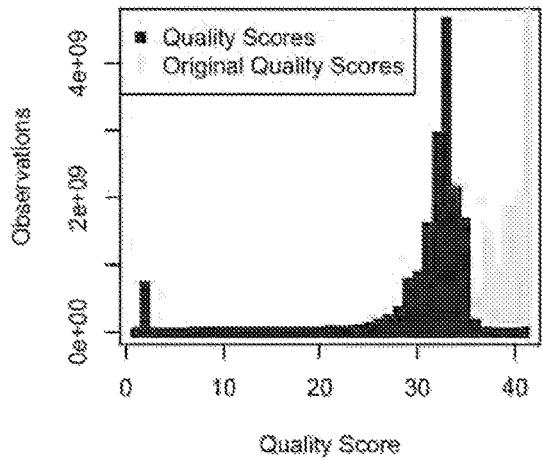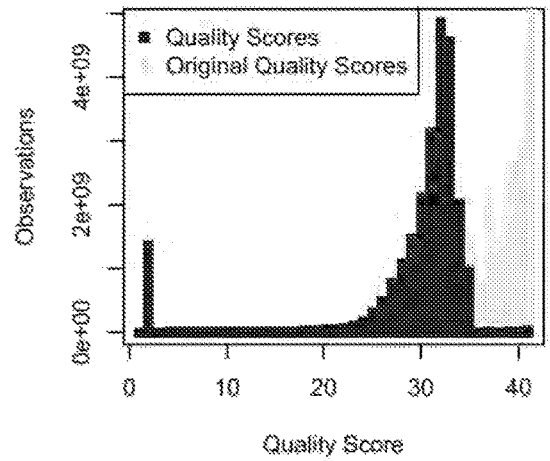
Figure 14Q

| | | | |
|---|---|---|---|
| n | 34 | 16 | 18 |
| Age (median, range) | 63 years (41-80) | 62 (56-73) | 63 (41-80) |
| Gender (n, %) | | | |
| Male | 16 (47) | 8 (50) | 8 (44) |
| Female | 18 (53) | 8 (50) | 10 (56) |
| Smoking status (n, %) | | | |
| Current | 7 (21) | 5 (31) | 2 (11) |
| Former | 21 (62) | 10 (63) | 11 (61) |
| Never | 6 (17) | 1 (6) | 5 (28) |
| Histology (n, %) | | | |
| Adenocarcinoma | 29 (85) | 15 (94) | 14 (78) |
| Squamous | 4 (12) | 1 (6) | 3 (17) |
| NSCLC NOS | 1 (3) | 0 (0) | 1 (6) |
| Driver oncogenes (n, %) | | | |
| KRAS mutant | 8 (24) | 5 (31) | 3 (17) |
| EGFR mutant | 2 (6) | 1 (6) | 1 (6) |
| ALK re-arranged | 1 (3) | 0 | 1 (6) |
| MK3475 as xx line of therapy (n, %) | | | |
| 1st | 9 (26) | 5 (31) | 4 (22) |
| 2nd | 11 (33) | 6 (38) | 5 (28) |
| 3rd | 5 (15) | 1 (6) | 4 (22) |
| 4th and beyond | 9 (26) | 4 (25) | 5 (28) |
| PDL1 expression (n, %) | | | |
| ≥1% | 31 (91) | 15 (94) | 16 (88) |
| <1% | 2 (6) | 1 (6) | 1 (6) |
| Unknown | 1 (3) | 0 (0) | 1 (6) |
| Dose of pembrolizumab (n, %) | | | |
| 2mg/kg | 5 (15) | 0 (0) | 5 (28) |
| 10mg/kg | 29 (85) | 16 (100) | 13 (72) |
| Confirmed objective response by irRC | | | |
| Partial response | 12 (35) | 5 (31) | 7 (39) |
| Stable disease | 9 (26) | 5 (31) | 5 (28) |
| Progressive disease | 13 (39) | 6 (38) | 6 (33) |
| Durable clinical benefit (PR/SD) > 6 months | | | |
| Yes | 14 (41) | 7 (44) | 7 (39) |
| No | 17 (50) | 9 (56) | 8 (44) |
| Not yet reached 6 month follow-up | 3 (9) | 0 | 3 (17) |
| Somatic non-synonymous mutation burden (median, range) | 200 (11-1192) | 207 (11-746) | 200 (35-1192) |
| Total somatic exonic mutation burden (median, range) | 327 (45-1732) | 309 (45-1011) | 322 (85-1732) |

Figure 15: Summary of clinical and genomic characteristics.

| Mutation measure | Patient population | n | Median mutations/sample (range) | CR/PR (%) | Fisher's p value | DCB/no DCB among evaluable patients (%) | PFS HR (p value) | Median PFS (months) | p value | HR (95% CI) |
|---|---|---|---|---|---|---|---|---|---|---|
| Nonsynonymous mutations | Disc. Cohort: high burden | 8 | 313 (228-746) | 5 (63) | 0.03 | 6 of 8 (75) | 0.04 | 14.5 | 0.01 | 0.19 (0.05-0.70) |
| | Disc. Cohort: low burden | 8 | 127 (11-190) | 0 (0) | | 1 of 8 (13) | | 3.7 | | |
| | Valid. Cohort: high burden | 9 | 368 (201-1192) | 5 (56) | 0.33 | 5 of 6^ (83) | 0.04 | Not reached | 0.006 | 0.15 (0.04-0.59) |
| | Valid. Cohort: low burden | 9 | 122 (35-198) | 2 (22) | | 2 of 9 (22) | | 3.4 | | |
| Nonsynonymous mutations | All patients: high burden | 17 | 324 (201-1192) | 10 (59) | 0.01 | 11 of 14^ (79) | 0.0011 | Not reached | 0.0004 | 0.19 (0.08-0.47) |
| | All patients: low burden | 17 | 122 (11-198) | 2 (12) | | 3 of 17 (18) | | 3.4 | | |
| Total exonic mutations | All patients: high burden | 17 | 494 (328-1732) | 8 | 0.28 | 9 of 14^ | 0.08 | 14.5 | 0.045 | 0.40 (0.17-0.98) |
| | All patients: low burden | 17 | 190 (45-326) | 4 | | 5 of 17 | | 4.1 | | |

Figure 16:

Figure 17:
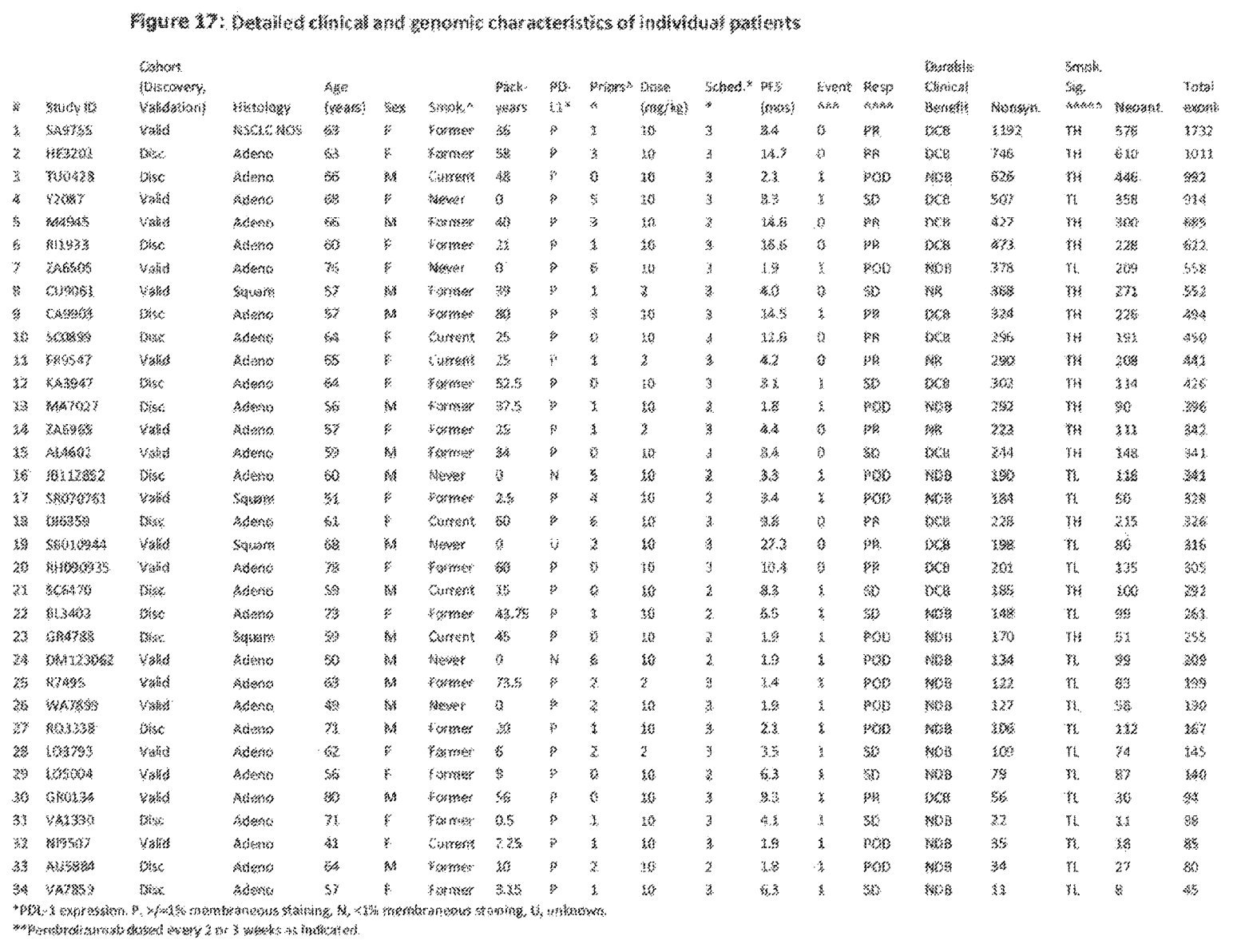

Figure 17: Detailed clinical and genomic characteristics of individual patients

| # | Study ID | Cohort (Discovery, Validation) | Histology | Age (years) | Sex | Smok.^ | Pack-years | PD-L1* | Priors^^ | Dose (mg/kg) | Sched.** | PFS (mos) | Event ^^^ | Resp ^^^^ | Durable Clinical Benefit | Nonsyn. | Smok. Sig. ^^^^^ | Neoant. | Total exonic |
|---|---|---|---|---|---|---|---|---|---|---|---|---|---|---|---|---|---|---|---|
| 1 | SA9755 | Valid | NSCLC NOS | 62 | F | Former | 36 | P | 1 | 10 | 3 | 8.4 | 0 | PR | DCB | 1192 | TH | 578 | 1732 |
| 2 | HE3201 | Disc | Adeno | 63 | F | Former | 58 | P | 3 | 10 | 3 | 14.7 | 0 | PR | DCB | 746 | TH | 610 | 1011 |
| 3 | TU0428 | Disc | Adeno | 66 | M | Current | 48 | P | 0 | 10 | 3 | 2.1 | 1 | POD | NDB | 626 | TH | 446 | 992 |
| 4 | Y2087 | Valid | Adeno | 68 | F | Never | 0 | P | 5 | 10 | 3 | 8.3 | 1 | SD | DCB | 507 | TL | 358 | 914 |
| 5 | M4945 | Valid | Adeno | 66 | M | Former | 40 | P | 3 | 10 | 3 | 14.8 | 0 | PR | DCB | 427 | TH | 300 | 885 |
| 6 | RI1933 | Disc | Adeno | 60 | F | Former | 21 | P | 1 | 10 | 3 | 16.6 | 0 | PR | DCB | 473 | TH | 228 | 622 |
| 7 | ZA6505 | Valid | Adeno | 76 | F | Never | 0 | P | 6 | 10 | 3 | 1.9 | 1 | POD | NDB | 378 | TL | 209 | 558 |
| 8 | CU9061 | Valid | Squam | 57 | M | Former | 39 | P | 1 | 2 | 3 | 4.0 | 0 | SD | NR | 368 | TH | 271 | 552 |
| 9 | CA9903 | Disc | Adeno | 57 | M | Former | 80 | P | 3 | 10 | 3 | 14.5 | 1 | PR | DCB | 334 | TH | 226 | 494 |
| 10 | SC0899 | Disc | Adeno | 64 | F | Current | 25 | P | 0 | 10 | 2 | 12.6 | 0 | PR | DCB | 296 | TH | 191 | 450 |
| 11 | FR9547 | Valid | Adeno | 65 | F | Current | 25 | P | 1 | 2 | 3 | 4.2 | 0 | PR | NR | 290 | TH | 208 | 441 |
| 12 | KA3947 | Disc | Adeno | 64 | F | Former | 52.5 | P | 0 | 10 | 3 | 8.1 | 1 | SD | DCB | 303 | TH | 114 | 426 |
| 13 | MA7027 | Disc | Adeno | 56 | M | Former | 37.5 | P | 1 | 10 | 2 | 1.8 | 1 | POD | NDB | 292 | TH | 90 | 396 |
| 14 | ZA6965 | Valid | Adeno | 57 | F | Former | 15 | P | 1 | 2 | 3 | 4.4 | 0 | PR | NR | 222 | TH | 111 | 342 |
| 15 | AL4602 | Valid | Adeno | 59 | M | Former | 34 | P | 0 | 10 | 2 | 8.4 | 0 | SD | DCB | 244 | TH | 148 | 341 |
| 16 | JB112852 | Disc | Adeno | 60 | M | Never | 0 | N | 5 | 10 | 2 | 3.3 | 1 | POD | NDB | 190 | TL | 118 | 341 |
| 17 | SR070761 | Valid | Squam | 51 | F | Former | 2.5 | P | 4 | 10 | 2 | 3.4 | 1 | POD | NDB | 184 | TL | 56 | 328 |
| 18 | DI6359 | Disc | Adeno | 61 | F | Current | 60 | P | 6 | 10 | 3 | 9.6 | 0 | PR | DCB | 228 | TH | 215 | 326 |
| 19 | SB010944 | Valid | Squam | 68 | M | Never | 0 | U | 2 | 10 | 3 | 27.3 | 0 | PR | DCB | 198 | TL | 80 | 316 |
| 20 | RH090935 | Valid | Adeno | 78 | F | Former | 60 | P | 0 | 10 | 3 | 10.4 | 0 | PR | DCB | 201 | TL | 135 | 305 |
| 21 | SC6470 | Disc | Adeno | 59 | M | Current | 15 | P | 0 | 10 | 2 | 8.3 | 1 | SD | DCB | 185 | TH | 100 | 292 |
| 22 | BL3403 | Disc | Adeno | 73 | F | Former | 43.75 | P | 1 | 10 | 2 | 6.5 | 1 | SD | NDB | 148 | TL | 99 | 263 |
| 23 | GR4788 | Disc | Squam | 59 | M | Current | 45 | P | 0 | 10 | 2 | 1.9 | 1 | POD | NDB | 170 | TH | 51 | 255 |
| 24 | DM123062 | Valid | Adeno | 50 | M | Never | 0 | N | 6 | 10 | 2 | 1.9 | 1 | POD | NDB | 134 | TL | 99 | 209 |
| 25 | R7495 | Valid | Adeno | 63 | M | Former | 73.5 | P | 2 | 2 | 3 | 1.4 | 1 | POD | NDB | 122 | TL | 83 | 199 |
| 26 | WA7899 | Valid | Adeno | 49 | M | Never | 0 | P | 2 | 10 | 3 | 1.9 | 1 | POD | NDB | 127 | TL | 58 | 190 |
| 27 | RO3338 | Disc | Adeno | 71 | M | Former | 30 | P | 1 | 10 | 3 | 2.1 | 1 | POD | NDB | 106 | TL | 112 | 167 |
| 28 | LO3793 | Valid | Adeno | 62 | F | Former | 6 | P | 2 | 2 | 3 | 3.5 | 1 | SD | NDB | 100 | TL | 74 | 145 |
| 29 | LO5004 | Valid | Adeno | 56 | F | Former | 8 | P | 0 | 10 | 2 | 6.3 | 1 | SD | NDB | 79 | TL | 87 | 140 |
| 30 | GR0134 | Valid | Adeno | 80 | M | Former | 56 | P | 0 | 10 | 3 | 9.3 | 1 | PR | DCB | 56 | TL | 30 | 94 |
| 31 | VA1330 | Disc | Adeno | 71 | F | Former | 0.5 | P | 1 | 10 | 3 | 4.1 | 1 | SD | NDB | 22 | TL | 11 | 88 |
| 32 | NI9507 | Valid | Adeno | 41 | F | Current | 7.25 | P | 1 | 10 | 3 | 1.9 | 1 | POD | NDB | 35 | TL | 18 | 85 |
| 33 | AU5884 | Disc | Adeno | 64 | M | Former | 10 | P | 2 | 10 | 2 | 1.8 | 1 | POD | NDB | 34 | TL | 27 | 80 |
| 34 | VA7859 | Disc | Adeno | 57 | F | Former | 3.15 | P | 1 | 10 | 3 | 6.3 | 1 | SD | NDB | 11 | TL | 8 | 45 |

*PDL-1 expression. P, >/=1% membraneous staining, N, <1% membraneous staining, U, unknown.

**Pembrolizumab dosed every 2 or 3 weeks as indicated.

Figure 18. Quality Metrics for All Samples.
N denotes corresponding normal. T denotes tumor DNA.

| Sample | Target Regions | Bases in Target Region | Bases Sequenced (after quality filtering) | Bases Mapped to Genome | Bases Mapped to Targeted Region | Mean Target Coverage | Targeted bases with at least 10 reads (%) |
|---|---|---|---|---|---|---|---|
| AL4602_N | 189894 | 32950014 | 132241930 | 97695214 | 4164823498 | 127.810477 | 0.947177 |
| AL4602_T | 189894 | 32950014 | 174485170 | 120860811 | 5253119108 | 161.46385 | 0.926297 |
| AU5884_N | 189894 | 32950014 | 86835468 | 55734427 | 2304570612 | 70.843604 | 0.921004 |
| AU5884_T | 189894 | 32950014 | 118497854 | 94583875 | 4170777521 | 128.058385 | 0.944011 |
| BL3403_N | 189894 | 32950014 | 136844124 | 108868175 | 4629994777 | 142.309651 | 0.948024 |
| BL3403_T | 189894 | 32950014 | 193069718 | 128204964 | 5821496528 | 178.814652 | 0.948857 |
| CA9903_N | 189894 | 32950014 | 64978750 | 54818581 | 2330210601 | 71.664859 | 0.927307 |
| CA9903_T | 189894 | 32950014 | 106928212 | 86438802 | 3862459107 | 118.675283 | 0.935412 |
| CU9061_N | 189894 | 32950014 | 117298018 | 98106296 | 3899679871 | 119.722037 | 0.943262 |
| CU9061_T | 189894 | 32950014 | 201703716 | 150891200 | 6320749651 | 193.970315 | 0.948994 |
| DI6359_N | 189894 | 32950014 | 68049462 | 56550125 | 2407997050 | 74.122135 | 0.925119 |
| DI6359_T | 189894 | 32950014 | 108808292 | 111211926 | 5019862373 | 154.345376 | 0.93985 |
| DM123062_N | 189894 | 32950014 | 124307348 | 98892835 | 4144985321 | 127.271343 | 0.940088 |
| DM123062_T | 189894 | 32950014 | 204675226 | 140756724 | 6221369654 | 190.844881 | 0.957608 |
| FR9547_N | 189894 | 32950014 | 101950653 | 84261089 | 3503354252 | 107.733974 | 0.937841 |
| FR9547_T | 189894 | 32950014 | 289002628 | 193741554 | 8143266088 | 249.718474 | 0.961299 |
| GR0134_N | 189894 | 32950014 | 104033858 | 85484869 | 3603388880 | 110.734625 | 0.940099 |
| GR0134_T | 189894 | 32950014 | 171945148 | 118503807 | 5065491487 | 155.356158 | 0.958604 |
| GR4788_N | 189894 | 32950014 | 130304080 | 103883167 | 4296757787 | 131.869884 | 0.948906 |
| GR4788_T | 189894 | 32950014 | 132101358 | 99136708 | 4175677808 | 128.244339 | 0.937001 |
| HE3302_N | 189894 | 32950014 | 82775862 | 67786929 | 2899163034 | 89.139081 | 0.937354 |
| HE3302_T | 189894 | 32950014 | 210811958 | 148137890 | 6177199349 | 189.705752 | 0.953064 |
| JB112852_N | 189894 | 32950014 | 134678418 | 105188597 | 4282140768 | 131.36132 | 0.948069 |
| JB112852_T | 189894 | 32950014 | 230739280 | 144875779 | 6466021193 | 198.480088 | 0.948037 |
| KA3947_N | 189894 | 32950014 | 77088996 | 63313850 | 2663182054 | 81.830577 | 0.930997 |
| KA3947_T | 189894 | 32950014 | 355786088 | 120760866 | 5290253334 | 162.673575 | 0.945223 |
| LO3793_N | 189894 | 32950014 | 132239512 | 103621709 | 4373397268 | 134.371784 | 0.947441 |
| LO3793_T | 189894 | 32950014 | 232306320 | 156548630 | 6847683860 | 197.894255 | 0.953127 |
| LO5004_N | 189894 | 32950014 | 144552248 | 114238256 | 4867705932 | 152.179572 | 0.945465 |
| LO5004_T | 189894 | 32950014 | 165483828 | 118709865 | 5123870335 | 157.417225 | 0.948988 |
| M4945_N | 189894 | 32950014 | 173996668 | 120449983 | 4973995139 | 152.876338 | 0.944888 |
| M4945_T | 189894 | 32950014 | 142573108 | 98036127 | 4379381020 | 134.605136 | 0.937004 |
| MA7027_N | 189894 | 32950014 | 83057014 | 68268266 | 2709982659 | 83.372841 | 0.927823 |
| MA7027_T | 189894 | 32950014 | 150331378 | 87306744 | 4207985362 | 129.24121 | 0.942497 |
| NI9507_N | 189894 | 32950014 | 83282298 | 67141865 | 2773039135 | 85.307215 | 0.934554 |
| NI9507_T | 189894 | 32950014 | 87518556 | 72125675 | 3122892732 | 96.15803 | 0.921913 |
| R7495_2_N | 189894 | 32950014 | 61239423 | 47497172 | 2066983168 | 63.708224 | 0.905358 |
| R7495_2_T | 189894 | 32950014 | 232334668 | 166758347 | 7041823600 | 216.094387 | 0.954353 |
| RH090935_N | 189894 | 32950014 | 182939372 | 110822654 | 4593839583 | 141.086216 | 0.947850 |
| RH090935_T | 189894 | 32950014 | 231189898 | 158799965 | 6670585439 | 204.865439 | 0.946123 |
| RI1933_N | 189894 | 32950014 | 61314862 | 51634872 | 2214858840 | 68.182206 | 0.923412 |
| RI1933_T | 189894 | 32950014 | 181659648 | 120801404 | 5374555898 | 164.983052 | 0.952961 |
| RO3338_N | 189894 | 32950014 | 114933782 | 92345228 | 3943073553 | 121.010249 | 0.945127 |
| RO3338_T | 189894 | 32950014 | 136807956 | 96927940 | 4122322714 | 126.57824 | 0.942479 |
| SA9755_N | 189894 | 32950014 | 212193658 | 155734006 | 6280943208 | 192.858579 | 0.955408 |
| SA9755_T | 189894 | 32950014 | 337403682 | 147998917 | 6733028155 | 206.860007 | 0.954466 |
| SB010944_N | 189894 | 32950014 | 130379650 | 101376126 | 4127460552 | 126.687778 | 0.943184 |
| SB010944_T | 189894 | 32950014 | 203661858 | 128276889 | 5703056039 | 175.015936 | 0.953241 |
| SO0899_N | 189894 | 32950014 | 88196986 | 70871472 | 3026465968 | 93.073728 | 0.939313 |
| SO0899_T | 189894 | 32950014 | 127981220 | 100522435 | 4377068882 | 134.578314 | 0.945167 |
| SO6470_N | 189894 | 32950014 | 55733342 | 47009993 | 1993480578 | 61.39547 | 0.911818 |

| | | | | | | | |
|---|---|---|---|---|---|---|---|
| SC6470_T | 189894 | 32950014 | 135739362 | 105861548 | 4692875668 | 144.26427 | 0.94648 |
| SR070761_N | 189894 | 32950014 | 158234930 | 124099331 | 5182991030 | 159.200873 | 0.949353 |
| SR070761_T | 189894 | 32950014 | 292050470 | 131933890 | 6207870162 | 190.519762 | 0.956945 |
| TUM28_N | 189894 | 32950014 | 127303050 | 101189405 | 4235332792 | 130.048835 | 0.947366 |
| TU0428_T | 189894 | 32950014 | 173450270 | 86564096 | 3680714004 | 113.378032 | 0.937217 |
| VA1330_N | 189894 | 32950014 | 69827552 | 55129933 | 2312376779 | 71.166279 | 0.922597 |
| VA1330_T | 189894 | 32950014 | 135610336 | 96504207 | 4086027942 | 125.711679 | 0.934442 |
| VA7859_N | 189894 | 32950014 | 63807140 | 53289713 | 2284415774 | 70.286595 | 0.924709 |
| VA7859_T | 189894 | 32950014 | 148703334 | 111998475 | 4935762628 | 151.640293 | 0.950753 |
| WA7899_N | 189894 | 32950014 | 160212294 | 123379606 | 4393264721 | 134.733791 | 0.948183 |
| WA7899_T | 189894 | 32950014 | 279269126 | 182086921 | 7605022449 | 233.286847 | 0.957596 |
| Y2087_N | 189894 | 32950014 | 122411904 | 80118204 | 3743932360 | 114.936891 | 0.940341 |
| Y2087_T | 189894 | 32950014 | 231934998 | 82257541 | 3928385204 | 120.578421 | 0.942763 |
| ZA6505_N | 189894 | 32950014 | 109178546 | 89123671 | 3725962819 | 114.631039 | 0.943478 |
| ZA6505_T | 189894 | 32950014 | 121363396 | 82900939 | 3440391275 | 105.85472 | 0.927052 |
| ZA6965_N | 189894 | 32950014 | 203970638 | 151245038 | 6220321827 | 190.965368 | 0.956282 |
| ZA6965_T | 189894 | 32950014 | 255234318 | 170201802 | 7383403623 | 226.370477 | 0.940373 |

Figure 18 (cont.)

FIGURE 19
19A
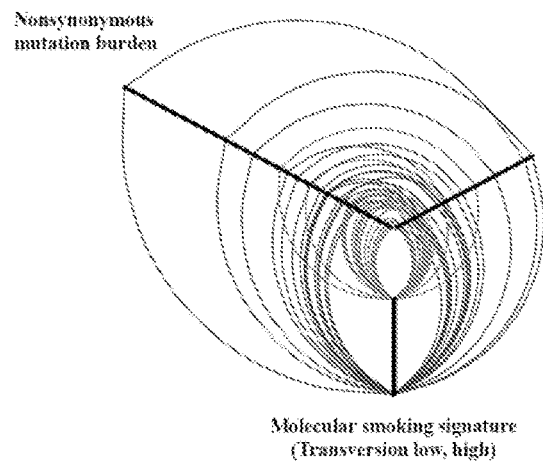
19B
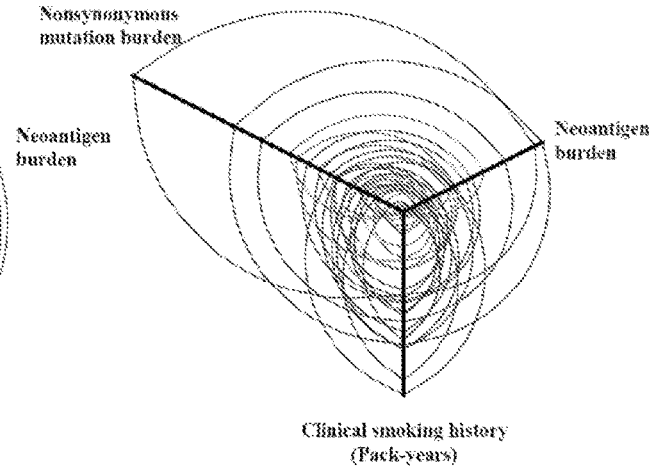

Figure 21: Immunogenic mutations, HLA Types, neoantigens, and predicted MHC binding Chr=chromosome. Position=location of mutation.
Ref=reference nucleotide (hg37 build). Alt=mutation.
Allele=HLA Class I allele predicted to bind mutant peptide
Mut Score=predicted MHC Class I binding score by NetMHC. Only those with a score ≤500nM are included.
WT Score=predicted MHC Class I binding score by NetMHC of wild type peptide corresponding to mutant.
Mut peptide=nonamer within a 17-amino acid sequence with centrally positioned mutant amino acid predicted to bind to the patient's MHC Class I.
WT peptide=wild type nonamer corresponding to the Mut peptide above.

| Sample | Gene | Chr | Position | Ref | Alt | HLA I Type | Allele | Mut Score | WT Score | Mut peptide | WT peptide |
|---|---|---|---|---|---|---|---|---|---|---|---|
| AL4602 | VWA1 | 1 | 1374587 | C | A | A0301,A3201,B0801,B5101,C0702,C1502 | B0801 | 430 | 4159 | Qgaarrqqi | Pgaarrqqi |
| AL4602 | CASZ1 | 1 | 10699817 | C | T | A0301,A3201,B0801,B5101,C0702,C1502 | A0301 | 103 | 195 | Mldsfkrfk | Vldsfkrfk |
| AL4602 | ATP13A2 | 1 | 17318822 | C | A | A0301,A3201,B0801,B5101,C0702,C1502 | A3201 | 98 | 368 | alqrmsvvL | alqrmsvvV |
| AL4602 | ATP13A2 | 1 | 17318822 | C | A | A0301,A3201,B0801,B5101,C0702,C1502 | C0702 | 490 | 411 | qrmsvvLaw | qrmsvvVaw |
| AL4602 | SH2D5 | 1 | 21049266 | C | T | A0301,A3201,B0801,B5101,C0702,C1502 | A0301 | 424 | 626 | qyfrnhlSr | qyfrnhlGr |
| AL4602 | SH2D5 | 1 | 21049266 | C | T | A0301,A3201,B0801,B5101,C0702,C1502 | A0301 | 373 | 1185 | hlSrycleh | hlGrycleh |
| AL4602 | SH2D5 | 1 | 21049266 | G | A | A0301,A3201,B0801,B5101,C0702,C1502 | C0702 | 355 | 448 | vfrnhlSry | vfrnhlGry |
| AL4602 | H5PG2 | 1 | 22198776 | G | A | A0301,A3201,B0801,B5101,C0702,C1502 | C1502 | 385 | 21971 | ltgeftveL | ltgeftveP |
| AL4602 | ZNF683 | 1 | 26694272 | C | T | A0301,A3201,B0801,B5101,C0702,C1502 | C1502 | 471 | 571 | qvfsackpi | qvfsacKpi |
| AL4602 | ARID1A | 1 | 27023633 | G | A | A0301,A3201,B0801,B5101,C0702,C1502 | A0301 | 372 | 581 | gaaaaTgsk | gaaaaAgsk |
| AL4602 | PPAP2B | 1 | 56990369 | G | A | A0301,A3201,B0801,B5101,C0702,C1502 | B0801 | 165 | 305 | isfrphfl | iGrfrphfl |
| AL4602 | HRNR | 1 | 152192039 | C | A | A0301,A3201,B0801,B5101,C0702,C1502 | C1502 | 210 | 73 | ssnVpbgsv | ssnGphgsv |
| AL4602 | NPR1 | 1 | 153652095 | G | A | A0301,A3201,B0801,B5101,C0702,C1502 | A3201 | 68 | 118 | klgdfvaTl | klgdfvaAl |
| AL4602 | NPR1 | 1 | 153652095 | G | A | A0301,A3201,B0801,B5101,C0702,C1502 | C1502 | 218 | 6745 | aTlhrrlgw | aAlhrrlgw |
| AL4602 | CD1A | 1 | 158277298 | G | T | A0301,A3201,B0801,B5101,C0702,C1502 | A3201 | 294 | 547 | alwfrkLcl | alwfrkRcl |
| AL4602 | OR6P1 | 1 | 158532614 | G | A | A0301,A3201,B0801,B5101,C0702,C1502 | A0301 | 127 | 139 | tlftyaWpr | tlftyaRpr |
| AL4602 | OR6P1 | 1 | 158532614 | G | A | A0301,A3201,B0801,B5101,C0702,C1502 | A3201 | 28 | 11403 | sstlftyaW | sstlftyaR |
| AL4602 | OR6P1 | 1 | 158532614 | G | A | A0301,A3201,B0801,B5101,C0702,C1502 | C0702 | 151 | 239 | ftyaWpram | ftyaRpram |
| AL4602 | OR6P1 | 1 | 158532614 | G | A | A0301,A3201,B0801,B5101,C0702,C1502 | C1502 | 32 | 30 | ftyaWpram | ftyaRpram |
| AL4602 | OR6P1 | 1 | 158532614 | G | A | A0301,A3201,B0801,B5101,C0702,C1502 | C1502 | 59 | 141 | yaWpramyt | yaRpramyt |
| AL4602 | OR10J1 | 1 | 159410378 | C | G | A0301,A3201,B0801,B5101,C0702,C1502 | C1502 | 42 | 41 | nSrehdqli | nTrehdqli |
| AL4602 | MARC2 | 1 | 220922141 | G | T | A0301,A3201,B0801,B5101,C0702,C1502 | A0303 | 345 | 20238 | girsgnlrY | girsgnrrD |
| AL4602 | MARC2 | 1 | 220922141 | G | T | A0301,A3201,B0801,B5101,C0702,C1502 | A3201 | 23 | 915 | rsgnlYrf | rsgnlrDrf |
| AL4602 | MARC2 | 1 | 220922141 | G | T | A0301,A3201,B0801,B5101,C0702,C1502 | B0801 | 10 | 24 | nlrYrfwlv | nlrDrfwlv |
| AL4602 | TRIM67 | 1 | 231349643 | G | T | A0301,A3201,B0801,B5101,C0702,C1502 | A3201 | 59 | 11745 | httlffinW | httlffinG |
| AL4602 | IRF2BP2 | 1 | 234744526 | C | A | A0301,A3201,B0801,B5101,C0702,C1502 | B0801 | 77 | 106 | gahkrpSsv | gahkrpAsv |
| AL4602 | IRF2BP2 | 1 | 234744526 | C | A | A0301,A3201,B0801,B5101,C0702,C1502 | C1502 | 486 | 665 | gahkrpSsv | gahkrpAsv |
| AL4602 | IRF2BP2 | 1 | 234744526 | C | A | A0301,A3201,B0801,B5101,C0702,C1502 | C1502 | 78 | 128 | Ssvsssaav | Asvsssaav |
| AL4602 | OR2M3 | 1 | 248367272 | G | A | A0301,A3201,B0801,B5101,C0702,C1502 | A0301 | 39 | 36 | raLmkligk | raFmkligk |
| AL4602 | OR2M3 | 1 | 248367272 | G | A | A0301,A3201,B0801,B5101,C0702,C1502 | C1502 | 327 | 241 | evtraLmki | evtraFmki |
| AL4602 | PSAP | 10 | 73579374 | A | T | A0301,A3201,B0801,B5101,C0702,C1502 | A0301 | 460 | 442 | ltvnMtqpk | ltvnVtqpk |
| AL4602 | TCERG1L | 10 | 132902598 | C | A | A0301,A3201,B0801,B5101,C0702,C1502 | A0301 | 40 | 130 | vsafstLek | vsafstWek |
| AL4602 | TCERG1L | 10 | 132902598 | C | A | A0301,A3201,B0801,B5101,C0702,C1502 | A0301 | 212 | 169 | stLekeihk | stWekeihk |
| AL4602 | OR4C15 | 11 | 55322010 | G | T | A0301,A3201,B0801,B5101,C0702,C1502 | C1502 | 222 | 341 | nvHeivfvv | nvQeivfvv |
| AL4602 | OR8K1 | 11 | 56114447 | A | T | A0301,A3201,B0801,B5101,C0702,C1502 | A0303 | 359 | 670 | alkrtLmr | alkrtLmr |

| | | | | | | | | | |
|---|---|---|---|---|---|---|---|---|---|
| CA9903 | GLYATL1 | 11 | 587711364 | G | A | A0201,A1101,B1801,B5108,C0701,C1602 | C0701 | 5 | 5 | Treehgryl | Arsehgryl |
| CA9903 | CCDC88B | 11 | 64112394 | G | A | A0201,A1101,B1801,B5108,C0701,C1602 | A0201 | 81 | 1172 | rfCleaveaa | rfCleaveaa |
| CA9903 | OR8B9 | 11 | 124310432 | C | A | A0201,A1101,B1801,B5108,C0701,C1602 | A0201 | 3 | 6 | yLneIvvfv | yVncxvvfv |
| CA9903 | PRDM10 | 11 | 129782029 | T | A | A0201,A1101,B1801,B5108,C0701,C1602 | C0701 | 275 | 135 | qhainqviln | qhaiqvQhi |
| CA9903 | VWF | 12 | 6155839 | G | C | A0201,A1101,B1801,B5108,C0701,C1602 | A1101 | 155 | 257 | sspkshR3k | sspkshR3k |
| CA9903 | PIK3C2G | 12 | 18719941 | C | G | A0201,A1101,B1801,B5108,C0701,C1602 | C0701 | 439 | 968 | rfrnLVnhy | rfrnLniry |
| CA9903 | KRAS | 12 | 25398285 | C | A | A0201,A1101,B1801,B5108,C0701,C1602 | A1101 | 69 | 107 | vvgaCgvgK | vvgaCgvgk |
| CA9903 | POP5 | 12 | 173018918 | C | T | A0201,A1101,B1801,B5108,C0701,C1602 | A1101 | 70 | 4141 | aSkirctqk | aSkirctqk |
| CA9903 | LATS2 | 13 | 21549285 | C | C | A0201,A1101,B1801,B5108,C0703,C1602 | A0203 | 50 | 381 | yvptishpi | yvptishpM |
| CA9903 | UPF3A | 13 | 115047496 | C | T | A0201,A1101,B1801,B5108,C0701,C1602 | A1101 | 370 | 221 | alskvirr | alskvirr |
| CA9903 | UPF3A | 13 | 115047496 | G | C | A0201,A1101,B1801,B5108,C0701,C1602 | C0701 | 388 | 591 | krtalskv | krtalskVv |
| CA9903 | TGM1 | 14 | 24730916 | G | C | A0201,A1101,B1801,B5108,C0701,C1602 | B1801 | 6 | 37 | yessdtiiF | yessdtttL |
| CA9903 | BCL11B | 14 | 99641604 | G | T | A0201,A1101,B1801,B5108,C0701,C1602 | C0701 | 37 | 55 | rhheaEpsl | rhheaDpsl |
| CA9903 | NFIA3 | 14 | 105923988.1 | C | A | A0201,A1101,B1801,B5108,C0701,C1602 | A1101 | 22 | 24 | qvyiSnynk | qvyiPnynk |
| CA9903 | HERC1 | 15 | 63948325 | G | A | A0201,A1101,B1801,B5108,C0701,C1602 | A1101 | 17 | 18 | asnaSaaak | asnaPaaak |
| CA9903 | SLC9A3R2 | 16 | 2083685 | C | T | A0201,A1101,B1801,B5108,C0701,C1602 | A0201 | 443 | 798 | hispMaaea | hispTaaea |
| CA9903 | DNAH3 | 16 | 221513969 | C | G | A0201,A1101,B1801,B5108,C0701,C1602 | A1101 | 321 | 274 | te5kfpqsr | tsLtfpqsr |
| CA9903 | DNAH3 | 16 | 221513969 | A | O | A0201,A1101,B1801,B5108,C0701,C1602 | B1801 | 117 | 63 | kevkcsStf | kevktsLtf |
| CA9903 | MRM2 | 16 | 553180.75 | T | T | A0201,A1101,B1801,B5108,C0703,C1602 | A0201 | 5 | 3 | Cehgdgypf | Wehgdgypf |
| CA9903 | VPS53 | 17 | 5268307 | G | A | A0201,A1101,B1801,B5108,C0701,C1602 | A0201 | 87 | 20112 | ktfsgrtit | kRfsgrtit |
| CA9903 | VPS53 | 17 | 5268307 | C | T | A0201,A1101,B1801,B5108,C0701,C1602 | B1801 | 65 | 267 | fegflakLf | fegflakRf |
| CA9903 | ATP2A3 | 17 | 3832738 | C | A | A0201,A1101,B1801,B5108,C0701,C1602 | C0701 | 189 | 114 | stsenqstl | sVsenqstl |
| CA9903 | PELP1 | 17 | 4576733 | C | A | A0201,A1101,B1801,B5108,C0701,C1602 | A0201 | 3 | 8 | rihdivtpl | rihdivLpl |
| CA9903 | PELP1 | 17 | 4576733 | G | T | A0201,A1101,B1801,B5108,C0701,C1602 | A0201 | 20 | 25 | IvFpluvngv | IvLpluvngv |
| CA9903 | SLC2A4 | 17 | 7187403 | G | A | A0201,A1101,B1801,B5108,C0701,C1602 | A0201 | 23 | 18 | iliTqvlgi | iliAqvlgi |
| CA9903 | TP53 | 17 | 7578394 | T | T | A0201,A1101,B1801,B5108,C0701,C1602 | A0201 | 337 | 431 | rrcphRerc | rrcphHerc |
| CA9903 | CTC1 | 17 | 8136328 | G | C | A0201,A1101,B1801,B5108,C0701,C1602 | A1101 | 72 | 41 | gvhvDsshk | gvhvAsshk |
| CA9903 | MYOCD | 17 | 12655927 | C | T | A0201,A1101,B1801,B5108,C0701,C1602 | A0201 | 22 | 538 | yqssstsv | yqssstsA |
| CA9903 | MYOCD | 17 | 12655927 | G | A | A0201,A1101,B1801,B5108,C0701,C1602 | A0201 | 36 | 190 | sVksngfyh | sAlsngfyh |
| CA9903 | TMEM98 | 17 | 31263385 | G | T | A0201,A1101,B1801,B5108,C0701,C1602 | A0201 | 51 | 216 | ttekival | ttekivakl |
| CA9903 | TMEM98 | 17 | 31263385 | G | A | A0201,A1101,B1801,B5108,C0701,C1602 | A1101 | 140 | 212 | altrngsgak | aMtrngsgak |
| CA9903 | TRIM37 | 17 | 467994723 | G | A | A0201,A1101,B1801,B5108,C0701,C1602 | B1801 | 36 | 29 | tekivalrm | teklvaMtm |
| CA9903 | INTS2 | 17 | 571250918 | G | A | A0201,A1101,B1801,B5108,C0701,C1602 | A0201 | 120 | 2189 | vlsnssFax | vlsnssVak |
| CA9903 | INTS2 | 17 | 599975356 | A | T | A0201,A1101,B1801,B5108,C0701,C1602 | A1101 | 21 | 53 | kteenHev | kteeHnRev |
| CA9903 | LHX1 | 17 | 599975356 | A | T | A0201,A1101,B1801,B5108,C0701,C1602 | A0203 | 393 | 6418 | fCdsactl | Kcdsactl |
| CA9903 | KRT14 | 17 | 397399912 | G | A | A0201,A1101,B1801,B5108,C0701,C1602 | A0201 | 488 | 2611 | tefCdsacf | tefCdsacf |
| CA9903 | CDC27 | 17 | 452473329 | G | T | A0201,A1101,B1801,B5108,C0701,C1602 | B1801 | 34 | 17 | tefCdsacf | tefCdsacf |
| CA9903 | CDC27 | 17 | 452473329 | C | C | A0201,A1101,B1801,B5108,C0701,C1602 | A1101 | 94 | 10796 | gQahktsk | gPahktsk |
| CA9903 | PRAC1 | 17 | 312633385 | C | A | A0201,A1101,B1801,B5108,C0701,C1602 | A0201 | 59 | 2189 | qldgsssV | qldgsssA |
| CA9903 | BPTF | 17 | 658902224 | A | A | A0201,A1101,B1801,B5108,C0701,C1602 | A1101 | 288 | 20377 | mvvwiswK | mvvwiswAt |
| CA9903 | BPTF | 17 | 658902224 | G | A | A0201,A1101,B1801,B5108,C0701,C1602 | A1103 | 176 | 19 | vvwlswKik | vvwlswMik |
| CA9903 | BPTF | 17 | 658902224 | G | A | A0201,A1101,B1801,B5108,C0701,C1602 | A0201 | 15 | 84 | alaieFav | alaileCav |
| CA9903 | ABCA6 | 17 | 658902224 | A | A | A0201,A1101,B1801,B5108,C0701,C1602 | A0201 | 319 | 235 | ileFovkpv | ileCavkpv |
| CA9903 | SDK2 | 17 | 713383257 | G | A | A0201,A1101,B1801,B5108,C0701,C1602 | A1103 | 242 | 1500 | lailefavk | lailleCavk |
| CA9903 | PIEZO2 | 17 | 106964494 | T | A | A0201,A1101,B1801,B5108,C0701,C1602 | A0201 | 24 | 133 | tefavkpvv | leCavkpvv |
| CA9903 | PIEZO2 | 18 | 106964494 | G | A | A0201,A1101,B1801,B5108,C0701,C1602 | A0201 | 282 | 26088 | tmrwktjasH | tmrwktjasH |
| CA9903 | | | | | | | A0203 | 36 | 3268 | eHeveevtmv | eQeeevtmv |
| CA9903 | | | | | | | A0201 | 87 | 1434 | Flnpeysav | Lihpeysav |
| CA9903 | | | | | | | A1101 | 167 | 489 | kqffynEih | kqffynLih |

Figure 21 (Cont.)

| | | | | | | | | | | |
|---|---|---|---|---|---|---|---|---|---|---|
| CA9903 | MUC16 | 19 | 9002632 | C | A | A0201,A1101,B1801,B5108,C0701,C1602 | A1101 | 143 | 783 | rvdavfthr | rvdavCtnr |
| CA9903 | OR7G1 | 19 | 9223670 | C | G | A0201,A1101,B1801,B5108,C0701,C1602 | A0203 | 21 | 1101 | sflygtafA | sflygtafG |
| CA9903 | OR7G1 | 19 | 9223670 | C | G | A0201,A1101,B1801,B5108,C0701,C1602 | A0201 | 146 | 3144 | fAvyissav | lGvyissav |
| CA9903 | ZNF675 | 19 | 23836812 | C | A | A0201,A1101,B1801,B5108,C0701,C1502 | C0701 | 203 | 15327 | tthkkihtV | tthkkihtG |
| CA9903 | ZNF675 | 19 | 23836812 | C | A | A0201,A1101,B1801,B5108,C0701,C1602 | C0701 | 250 | 58 | ihtVeqpyi | ihtGeqpyi |
| CA9903 | ZNF226 | 19 | 44679169 | G | T | A0201,A1101,B1801,B5108,C0701,C1602 | A0201 | 99 | 344 | ifIyYtaqt | ifIyDlaqt |
| CA9903 | ZNF226 | 19 | 44679169 | G | T | A0201,A1101,B1801,B5108,C0701,C1602 | A1101 | 183 | 17569 | hvkaflyY | hvkaflyD |
| CA9903 | C5AR1 | 19 | 47823770 | G | G | A0201,A1101,B1801,B5108,C0701,C1602 | A0301 | 64 | 60 | kttkvvCav | kttkvvVav |
| CA9903 | LILRB3 | 19 | 54725905 | G | C | A0201,A1101,B1801,B5108,C0703,C0703,C1603 | A0203 | 487 | 945 | sqkggyQhfv | sqkggyChfv |
| CA9903 | LILRB3 | 19 | 54725905 | G | C | A0201,A1101,B1801,B5108,C0701,C3602 | C0701 | 83 | 83 | gyQhfvlmk | gyHhfvlmk |
| CA9903 | NLRP7 | 19 | 55450270 | G | A | A0201,A1101,B1801,B5108,C0701,C3602 | A1101 | 116 | 82 | mdfetHef | mdfetDief |
| CA9903 | NLRP7 | 19 | 55450270 | G | A | A0201,A1101,B1801,B5108,C0701,C3602 | B1801 | 474 | 1478 | fetEietes | fetDiefes |
| CA9903 | NLRP7 | 19 | 55450270 | G | A | A0201,A1101,B1801,B5108,C0701,C3602 | C0701 | 286 | 1482 | nymdfetlEi | nymdfetDi |
| CA9903 | NLRP11 | 19 | 56303739 | G | C | A0201,A1101,B1801,B5108,C0701,C3602 | A0201 | 126 | 16885 | rqldicvnL | rqldicvnR |
| CA9903 | NLRP11 | 19 | 56303739 | C | G | A0201,A1101,B1801,B5108,C0701,C3602 | A0303 | 448 | 765 | qldicvnL | qldicvnR |
| CA9903 | DOX1 | 2 | 74745345 | C | T | A0201,A1101,B1801,B5108,C0701,C1602 | C0701 | 249 | 120 | trsfvnpri | trsVynpri |
| CA9903 | SEMA4C | 2 | 97527324 | C | A | A0201,A1101,B1801,B5108,C0701,C1602 | A1101 | 72 | 43 | gscnlrgSk | gacnlrgSk |
| CA9903 | MYO7B | 2 | 128343864 | C | G | A0201,A1101,B1801,B5108,C0701,C3602 | A0203 | 196 | 250 | kapphqIvev | kapphqYev |
| CA9903 | WDR33 | 2 | 128471573 | T | A | A0201,A1101,B1801,B5108,C0703,C1602 | C0701 | 108 | 93 | srgppnLhrm | srgppnHhrm |
| CA9903 | LRP1B | 2 | 141533727 | G | T | A0201,A1101,B1801,B5108,C0701,C3602 | A0201 | 143 | 275 | lrnktsgvv | Lrnktsgvv |
| CA9903 | GALNT5 | 2 | 158142604 | T | G | A0201,A1101,B1801,B5108,C0701,C1602 | C0701 | 318 | 304 | hlkerhCl | hlkerhGl |
| CA9903 | TTN | 2 | 179612473 | T | T | A0201,A1101,B1801,B5108,C0701,C1602 | A0201 | 31 | 9573 | emietsfsQ | emietsfsQ |
| CA9903 | TTN | 2 | 179612473 | T | T | A0201,A1101,B1801,B5108,C0701,C1602 | A1101 | 10 | 11 | tsfsLrnipk | tsfsQrnipk |
| CA9903 | TTN | 2 | 179654796 | G | C | A0201,A1101,B1801,B5108,C0701,C1602 | A0301 | 63 | 108 | kvivVtpkv | kvivAtpkv |
| CA9903 | ALS2 | 2 | 202591214 | C | G | A0201,A1101,B1801,B5108,C0701,C1602 | A1103 | 56 | 17266 | sgmfrngIE | sgmfrngIE |
| CA9903 | ALS2 | 2 | 202591214 | C | G | A0201,A1101,B1801,B5108,C0701,C1602 | C0701 | 356 | 677 | frngIEdgy | frngIEdgy |
| CA9903 | CD28 | 2 | 204594440 | C | G | A0201,A1101,B1801,B5108,C0701,C1602 | A0201 | 96 | 526 | vvlvvvGgv | vvlvvvCgv |
| CA9903 | ITM2C | 2 | 231729855 | G | A | A0201,A1101,B1801,B5108,C0701,C1602 | B1801 | 158 | 218 | teililtgTr | teililtpAr |
| CA9903 | OR6B2 | 2 | 240669313 | T | T | A0201,A1101,B1801,B5108,C0701,C1602 | A0201 | 251 | 449 | vfnhfLcdi | vfnhfFcdi |
| CA9903 | OR6B2 | 2 | 240669313 | T | T | A0201,A1101,B1801,B5108,C0701,C1602 | A0201 | 5 | 3107 | fLcdispil | fFcdispil |
| CA9903 | APMAP | 20 | 24952397 | A | A | A0201,A1101,B1801,B5108,C0701,C1602 | C0701 | 221 | 280 | evnpwRrev | evnpwKrev |
| CA9903 | KCNG1 | 20 | 49636764 | G | C | A0201,A1101,B1801,B5108,C0701,C1602 | A1101 | 110 | 173 | qaikgSfyr | qaikgAfyr |
| CA9903 | KCNG1 | 20 | 49626764 | G | C | A0201,A1101,B1801,B5108,C0701,C1602 | A1101 | 224 | 511 | aikgSfyrr | aikgAfyrr |
| CA9903 | KCNG1 | 20 | 49626764 | G | C | A0201,A1101,B1801,B5108,C0701,C1602 | A1101 | 121 | 587 | gSfyrraqr | gAfyrraqr |
| CA9903 | KCNG1 | 20 | 49626764 | G | C | A0201,A1101,B1801,B5108,C0701,C1602 | C0701 | 236 | 678 | Sfyrraqri | Afyrraqri |
| CA9903 | TSHZ2 | 20 | 51870152 | G | A | A0201,A1101,B1801,B5108,C0701,C1602 | B1801 | 328 | 516 | Velerkzpeq | Eelerkzpeq |
| CA9903 | SMTN | 22 | 31484745 | A | A | A0201,A1101,B1801,B5108,C0701,C1602 | C0701 | 21 | 19 | irrvWaqei | irrvRaqei |
| CA9903 | INPP5J | 22 | 31520945 | G | A | A0201,A1101,B1801,B5108,C0701,C1602 | A1103 | 151 | 17648 | aamsasseR | aamsasseG |
| CA9903 | KLHL4 | 22 | 38823622 | A | A | A0201,A1101,B1801,B5108,C0701,C1602 | A1101 | 44 | 34 | frngtilak | frngtHMak |
| CA9903 | KCNJ4 | 22 | 38823632 | T | A | A0201,A1101,B1801,B5108,C0701,C1602 | A1101 | 252 | 99 | gtliakmar | gtliMakmas |
| CA9903 | KCNJ4 | 22 | 39823622 | T | A | A0201,A1101,B1801,B5108,C0701,C1602 | A1103 | 80 | 124 | iliakmarpk | iMakmarpk |
| CA9903 | SREBF2 | 22 | 42266968 | T | A | A0201,A1101,B1801,B5108,C0701,C1602 | A0201 | 81 | 70 | vksavvqrpa | vKsavvqrpa |
| CA9903 | ITGA9 | 3 | 37670769 | T | T | A0201,A1101,B1801,B5108,C0701,C1602 | A1101 | 121 | 587 | eliLpltpvi | eliPpltpvi |
| CA9903 | BSN | 3 | 49689586 | G | A | A0201,A1101,B1801,B5108,C0701,C1602 | A1103 | 303 | 2762 | atsVrglak | atsGrglak |
| CA9903 | STAB1 | 3 | 52551123 | A | T | A0201,A1101,B1801,B5108,C0701,C1602 | A1103 | 20 | 20 | ymgBgeicQ | ymgHgeicQ |
| CA9903 | VGLL3 | 3 | 87027729 | G | A | A0201,A1101,B1801,B5108,C0701,C1602 | A0201 | 17 | 4600 | algqaititL | algqaititH |
| CA9903 | BCC | 3 | 112968686 | T | T | A0201,A1101,B1801,B5108,C0701,C1602 | A0203 | 101 | 252233 | gmSpevtla | gmRpevtla |
| CA9903 | SIDT1 | 3 | 113303984 | T | T | A0201,A1101,B1801,B5108,C0701,C1602 | A0203 | 310 | 4892 | vifsaihV | vifsaihV |
| CA9903 | SIDT1 | 3 | 113303984 | T | T | A0201,A1101,B1801,B5108,C0701,C1602 | A3201 | 9 | 44 | saihFlasl | saihVlasl |
| CA9903 | SIDT1 | 3 | 113303984 | T | T | A0201,A1101,B1801,B5108,C0701,C1602 | A3201 | 282 | 504 | saihFlasl | saihVlasl |

Figure 21 (Cont.)

| | | | | | | | | | |
|---|---|---|---|---|---|---|---|---|---|
| CA9903 | SIDT1 | 3 | 113330984 | G | T | A0201,A1101,B1801,B5108,C0701,C1602 | A0201 | 42 | 499 | Flaslalst | Vlaslalst |
| CA9903 | SIDT1 | 3 | 113330984 | G | T | A0201,A1101,B1801,B5108,C0701,C1602 | C0701 | 50 | 457 | ihFlaslal | ihVlaslai |
| CA9903 | P3JA5 | 3 | 122873818 | G | T | A0201,A1101,B1801,B5108,C0701,C1602 | A0201 | 47 | 17692 | tlvmfyapL | tlvmfyapW |
| CA9903 | SHOX2 | 3 | 157815905 | C | A | A0201,A1101,B1801,B5108,C0701,C1602 | A1101 | 28 | 37 | vvaaSsaak | vvaaAaaak |
| CA9903 | SHOX2 | 3 | 157815905 | C | A | A0201,A1101,B1801,B5108,C0701,C1602 | A1101 | 42 | 68 | Saaakttsk | Aaaakttsk |
| CA9903 | WDR49 | 3 | 167277886 | C | A | A0201,A1101,B1801,B5108,C0701,C1602 | A0201 | 191 | 433 | aldanetrl | aldanetRl |
| CA9903 | WDR49 | 3 | 167277886 | C | A | A0201,A1101,B1801,B5108,C0701,C1602 | B1801 | 456 | 1943 | netlLtkgs | netRltkgs |
| CA9903 | WDR49 | 3 | 167277886 | C | A | A0201,A1101,B1801,B5108,C0701,C1602 | C0701 | 294 | 11496 | makianetl | makianeeR |
| CA9903 | JAKMIP1 | 4 | 6107622 | A | G | A0201,A1101,B1801,B5108,C0701,C1602 | A1103 | 30 | 26 | htaHiseik | htaYiselk |
| CA9903 | JAKMIP1 | 4 | 6107622 | A | G | A0201,A1101,B1801,B5108,C0701,C1602 | C0701 | 9 | 11 | rhtaHIsei | rhtaYIsei |
| CA9903 | AP8B2 | 4 | 40827923 | T | A | A0201,A1101,B1801,B5108,C0701,C1602 | A0201 | 6 | 24 | vqylgmFpv | vqylgmLpv |
| CA9903 | AP8B2 | 4 | 40827923 | T | A | A0201,A1101,B1801,B5108,C0701,C1602 | A0203 | 27 | 43 | gmFpvdkpv | gmLpvdkpv |
| CA9903 | AP8B2 | 4 | 40827923 | T | A | A0201,A1101,B1801,B5108,C0701,C1602 | C0701 | 170 | 26 | fhvqvlgnF | fhvvylgmL |
| CA9903 | GABRB1 | 4 | 47322211 | C | A | A0201,A1101,B1801,B5108,C0701,C1602 | B1801 | 167 | 402 | deqnctMei | deqnctLei |
| CA9903 | EGF | 4 | 110862211 | G | A | A0201,A1101,B1801,B5108,C0701,C1602 | A1103 | 72 | 102 | kdfhynek | kMdfhynek |
| CA9903 | UGT8 | 4 | 115597231 | T | C | A0201,A1101,B1801,B5108,C0701,C1602 | A0201 | 415 | 878 | istcHyfi | istcQyfi |
| CA9903 | UGT8 | 4 | 115597231 | T | C | A0201,A1101,B1801,B5108,C0701,C1602 | A1101 | 427 | 9022 | avhqistcH | avhqistcQ |
| CA9903 | UGT8 | 4 | 115597231 | T | C | A0201,A1101,B1801,B5108,C0701,C1602 | B1801 | 398 | 835 | Hyfildisi | Qyfildisaf |
| CA9903 | ZNF827 | 4 | 146770524 | C | A | A0201,A1101,B1801,B5108,C0701,C1602 | A0201 | 55 | 15 | nlfiqdisv | nlfSqdisv |
| CA9903 | ZNF827 | 4 | 146770524 | C | A | A0201,A1101,B1801,B5108,C0701,C1602 | A0203 | 145 | 6730 | flqdisvkm | fSqdisvkm |
| CA9903 | TENM3 | 4 | 183603095 | G | T | A0201,A1101,B1801,B5108,C0701,C1602 | B1801 | 178 | 49 | dqcsgNgtv | dqcsgHgtv |
| CA9903 | CTNND2 | 5 | 11159752 | C | G | A0201,A1101,B1801,B5108,C0701,C1602 | C0701 | 34 | 2148 | Hflhssqel | IQlhssqvl |
| CA9903 | SPEF2 | 5 | 35704717 | G | T | A0201,A1101,B1801,B5108,C0701,C1602 | A1101 | 38 | 17123 | isqrvazaek | isqrvazaeN |
| CA9903 | RASGRF2 | 5 | 80375978 | C | G | A0201,A1101,B1801,B5108,C0701,C1602 | A0201 | 4 | 370 | flheifhqV | flheifhqS |
| CA9903 | RASGRF2 | 5 | 80375978 | C | G | A0201,A1101,B1801,B5108,C0701,C1602 | C0701 | 182 | 427 | lheifhqVl | lheifhqGl |
| CA9903 | RASGRF2 | 5 | 80375978 | C | G | A0201,A1101,B1801,B5108,C0701,C1602 | C0701 | 215 | 58 | fhqVlkari | fhqGlkari |
| CA9903 | TMED7-TICAM2 | 5 | 114916850 | T | C | A0201,A1101,B1801,B5108,C0701,C1602 | C0701 | 171 | 5535 | sRksedksi | sRksedlsi |
| CA9903 | ARSI | 5 | 149677304 | G | T | A0201,A1101,B1801,B5108,C0701,C1602 | A1101 | 23 | 15750 | gvegfdthK | gvegfdthE |
| CA9903 | KIF13A | 6 | 17837806 | C | T | A0201,A1101,B1801,B5108,C0701,C1602 | A1101 | 51 | 19518 | gsninkslK | gsninkslT |
| CA9903 | SLC17A5 | 6 | 25850739 | A | G | A0201,A1101,B1801,B5108,C0701,C1602 | A1101 | 180 | 424 | stmAvyvpt | stmVvyvpt |
| CA9903 | HIST1H2BJ | 6 | 27100417 | T | A | A0201,A1101,B1801,B5108,C0701,C1602 | A1103 | 18 | 19 | esYsiyvyk | esYskyvyk |
| CA9903 | HIST1H2BJ | 6 | 27100417 | T | A | A0201,A1101,B1801,B5108,C0701,C1602 | B1803 | 15 | 16 | keeFsiyvy | keeYsiyvy |
| CA9903 | FOXP4 | 6 | 41545819 | G | A | A0201,A1101,B1801,B5108,C0701,C1602 | A0201 | 434 | 597 | kqsasavAv | kqsasavQv |
| CA9903 | FOXP4 | 6 | 41545819 | G | A | A0201,A1101,B1801,B5108,C0701,C1602 | C0701 | 241 | 9947 | vHvpvsvam | yQvpvsvam |
| CA9903 | RPL7L1 | 6 | 42852473 | C | T | A0201,A1101,B1801,B5108,C0701,C1602 | A0201 | 111 | 50 | mlrivelyv | mhrivePrv |
| CA9903 | RPL7L1 | 6 | 42852473 | C | T | A0201,A1101,B1801,B5108,C0701,C1602 | A1101 | 307 | 342 | kmlrively | kmlrivePy |
| CA9903 | RPL7L1 | 6 | 42852473 | C | T | A0201,A1101,B1801,B5108,C0701,C1602 | B1801 | 6 | 36 | velyvlwgf | vePyvtwgf |
| CA9903 | FAM83B | 6 | 54806671 | A | C | A0201,A1101,B1801,B5108,C0701,C1602 | A1103 | 105 | 29 | atLgrsygr | atMgrsygr |
| CA9903 | MYO6 | 6 | 76624595 | G | T | A0201,A1101,B1801,B5108,C0701,C1602 | C0701 | 130 | 206 | trkrgPeti | trkrgAeli |
| CA9903 | DOPEY1 | 6 | 83840101 | G | T | A0201,A1101,B1801,B5108,C0701,C1602 | A1101 | 76 | 163 | iaeAtteffx | iaeKteffx |
| CA9903 | ZNF292 | 6 | 87967981 | C | T | A0201,A1101,B1801,B5108,C0701,C1602 | C0701 | 382 | 7555 | lhtvchpni | lhtvchpmT |
| CA9903 | CCR6 | 6 | 167550402 | C | G | A0201,A1101,B1801,B5108,C0701,C1602 | A0201 | 74 | 114 | flipMfmi | flipiMfmi |
| CA9903 | IGFBP1 | 7 | 45931537 | C | G | A0201,A1101,B1801,B5108,C0701,C1602 | C0701 | 131 | 91 | Grielyrvv | Crielyrvv |
| CA9903 | ABCA13 | 7 | 48556373 | G | A | A0201,A1101,B1801,B5108,C0701,C1602 | A0203 | 213 | 4293 | rifsssYva | rifsssDva |
| CA9903 | ABCA13 | 7 | 48556373 | G | A | A0201,A1101,B1801,B5108,C0701,C1602 | A0201 | 93 | 637 | fsssYvafi | fsssDvafi |
| CA9903 | ABCA13 | 7 | 48556373 | G | A | A0201,A1101,B1801,B5108,C0701,C1602 | A1101 | 21 | 160 | ssYvafisy | ssDvafisy |
| CA9903 | ABCA13 | 7 | 48556373 | G | A | A0201,A1101,B1801,B5108,C0701,C1602 | C0701 | 153 | 967 | srifsssYv | srifsssDv |
| CA9903 | ABCA13 | 7 | 48556373 | G | A | A0201,A1101,B1801,B5108,C0701,C1602 | C0701 | 399 | 1527 | fsssYvafi | fsssDvafi |
| CA9903 | GRM3 | 7 | 86479774 | T | C | A0201,A1101,B1801,B5108,C0701,C1602 | A1101 | 21 | 28 | hulfqpqk | hulfapqk |

| | | | | | | | | | |
|---|---|---|---|---|---|---|---|---|---|
| HE3202 | DERMD4B | 1 | 1539053348 | A | T | A2403,A3201,B3801,B4101,C1203,C1701 | C1203 | 206 | 198 | qtlErpsv | qtlErpsv |
| HE3202 | FDPS | 1 | 1552795585 | C | T | A2403,A3201,B3801,B4101,C1203,C1701 | C1203 | 314 | 2243 | tLswlrsv | Plsrwlrsv |
| HE3202 | ATP1A2 | 1 | 1601003328 | G | T | A2403,A3201,B3801,B4101,C1203,C1701 | C1203 | 13 | 52 | miYppraav | miOppraav |
| HE3202 | PMO4 | 1 | 1713103772 | G | A | A2403,A3201,B3801,B4101,C1203,C1701 | A2403 | 250 | 1419 | qwKrtlkpi | qwDrtlkpi |
| HE3202 | AXDND1 | 1 | 1794141169 | A | T | A2403,A3201,B3801,B4101,C1203,C1701 | C1203 | 143 | 86 | skydtlMii | skydtlKii |
| HE3202 | AXDND1 | 1 | 1794141169 | A | A | A2403,A3201,B3801,B4101,C1203,C1701 | C1203 | 332 | 199 | dtlMikhi | dtlKikhI |
| HE3202 | RGS8 | 1 | 1826353094 | C | C | A2403,A3201,B3801,B4101,C1203,C1701 | C1203 | 10091 | 10091 | mprrnkgmM | mprrnkgmK |
| HE3202 | ASPM | 1 | 1970707786 | C | A | A2403,A3201,B3801,B4101,C1203,C1701 | A3301 | 107 | 22 | rqCnsavvi | rqWhsavvi |
| HE3202 | ASPM | 1 | 1970707788 | G | A | A2403,A3201,B3801,B4101,C1203,C1701 | C1203 | 39 | 25 | yirqChsav | yirqWhsav |
| HE3202 | ASPM | 1 | 1970707788 | G | A | A2403,A3201,B3801,B4101,C1203,C1701 | C1203 | 139 | 132 | rqChsavvi | rqWhsavvi |
| HE3202 | ASPM | 1 | 1970707789 | C | A | A2403,A3201,B3801,B4101,C1203,C1701 | A3201 | 40 | 22 | rqLhsavvi | rqWhsavvi |
| HE3202 | ASPM | 2 | 1970707789 | C | A | A2403,A3201,B3801,B4101,C1203,C1701 | C1203 | 99 | 25 | yirqLhsav | yirqWhsav |
| HE3202 | ASPM | 1 | 1970707789 | C | A | A2403,A3201,B3801,B4101,C1203,C1701 | C1203 | 94 | 132 | rqLhsavvi | rqWhsavvi |
| HE3202 | IGFAL1 | 1 | 2011953591 | A | T | A2403,A3201,B3801,B4101,C1203,C1701 | C1203 | 452 | 366 | kpYcpqgpm | kpOppqgpm |
| HE3202 | IGFM1 | 1 | 2011877709 | G | A | A2403,A3201,B3801,B4101,C1203,C1701 | C1203 | 487 | 226 | cqyefQvta | cqyeffvta |
| HE3202 | IGFM1 | 1 | 2011877709 | G | A | A2403,A3201,B3801,B4101,C1203,C1701 | C1203 | 304 | 238 | yefQvtava | peRvtava |
| HE3202 | TAF1A | 1 | 2227537428 | C | C | A2403,A3201,B3801,B4101,C1203,C1701 | A3201 | 12 | 43 | klmLQfhtl | klmLEfhtl |
| HE3202 | TAF1A | 1 | 2227537428 | C | G | A2403,A3201,B3801,B4101,C1203,C1701 | A3201 | 365 | 381 | lmlQfhtll | lmlEfhtll |
| HE3202 | TAF1A | 1 | 2227537428 | C | G | A2403,A3201,B3801,B4101,C1203,C1701 | C1203 | 468 | 129 | lmlQfhtll | lmlEfhtll |
| HE3202 | RAB4A | 1 | 2294353362 | A | A | A2403,A3201,B3801,B4101,C1203,C1701 | A3201 | 311 | 1530 | vffleaTrf | vffleaSrf |
| HE3202 | TTC13 | 1 | 2310614818 | G | G | A2403,A3201,B3801,B4101,C1203,C1701 | C1203 | 57 | 2438 | reysryfhN | reysryfhA |
| HE3202 | TTC13 | 1 | 2310648518 | G | G | A2403,A3201,B3801,B4101,C1203,C1701 | C1203 | 121 | 134 | ysryfhVhl | ysryfhAhi |
| HE3202 | RYR2 | 1 | 2377637433 | C | A | A2403,A3201,B3801,B4101,C1203,C1701 | A3201 | 81 | 93 | qaknmsSai | qaknmsAai |
| HE3202 | RYR2 | 1 | 2379474315 | C | T | A2403,A3201,B3801,B4101,C1203,C1701 | A2403 | 4 | 5 | yfqpHgSi | yfqpHgRi |
| HE3202 | RYR2 | 2 | 2379474315 | T | A | A2403,A3201,B3801,B4101,C1203,C1701 | C1203 | 28 | 62 | yfqpHgSi | yfqpHgRi |
| HE3202 | RYR2 | 1 | 2379474315 | T | A | A2403,A3201,B3801,B4101,C1203,C1701 | C1203 | 232 | 176 | qpHgSiei | qpHgRiei |
| HE3202 | OR2W3 | 1 | 2480593315 | G | A | A2403,A3201,B3801,B4101,C1203,C1701 | A3201 | 383 | 274 | rlcrClvsv | rlcrGlvsv |
| HE3202 | OR2W3 | 1 | 2480593315 | G | C | A2403,A3201,B3801,B4101,C1203,C1701 | C1203 | 333 | 391 | rlcrClvsv | rlcrGlvsv |
| HE3202 | OR2A2 | 1 | 2484343719 | C | C | A2403,A3201,B3801,B4101,C1203,C1701 | A3201 | 11 | 12 | klcgMatf | klcgMatf |
| HE3202 | OR2T12 | 1 | 2484593341 | C | C | A2403,A3201,B3801,B4101,C1203,C1701 | A2403 | 307 | 122 | htfceaRvl | htfceaPvl |
| HE3202 | OR2T12 | 1 | 2484584342 | G | C | A2403,A3201,B3801,B4101,C1203,C1701 | C1203 | 50 | 40 | ffceaRvlv | ffceaPvlv |
| HE3202 | OR2T34 | 1 | 2487537725 | G | T | A2403,A3201,B3801,B4101,C1203,C1701 | A3201 | 115 | 25 | iqmffhlME | iqrnffhltL |
| HE3202 | OR2T34 | 1 | 2487537725 | G | C | A2403,A3201,B3801,B4101,C1203,C1701 | A3201 | 159 | 459 | ltMagaevf | ItLagaevf |
| HE3202 | OR2T34 | 1 | 2487737725 | G | C | A2403,A3201,B3801,B4101,C1203,C1701 | C1203 | 231 | 258 | iqmffhltM | iqrnffhltL |
| HE3202 | OR2T34 | 1 | 2487737725 | C | C | A2403,A3201,B3801,B4101,C1203,C1701 | C1203 | 300 | 517 | ItMagaevf | ItLagaevf |
| HE3202 | OR2T27 | 1 | 2488141155 | G | A | A2403,A3201,B3801,B4101,C1203,C1701 | A2403 | 114 | 1347 | snysvyaYf | snysvyaDfi |
| HE3202 | OR2T27 | 1 | 2488141155 | G | A | A2403,A3201,B3801,B4101,C1203,C1701 | A2403 | 10 | 22 | nysvyaYfi | nysvyaDfii |
| HE3202 | OR2T27 | 1 | 2488141155 | C | A | A2403,A3201,B3801,B4101,C1203,C1701 | A2403 | 5 | 9660 | aYfillgif | aLfillgif |
| HE3202 | OR2T27 | 1 | 2488141155 | C | A | A2403,A3201,B3801,B4101,C1203,C1701 | A3201 | 171 | 10321 | qsnysvyaY | qsnysvyaD |
| HE3202 | OR2T27 | 1 | 2488141155 | C | C | A2403,A3201,B3801,B4101,C1203,C1701 | C1203 | 492 | 1134 | ysvyaYfii | ysvyaDfii |
| HE3202 | OR2T27 | 1 | 2488141155 | C | G | A2403,A3201,B3801,B4101,C1203,C1701 | C1203 | 427 | 373 | svyaYfii | svyaDfii |
| HE3202 | OR2T27 | 1 | 2488141155 | C | U | A2403,A3201,B3801,B4101,C1203,C1701 | C1203 | 14 | 158 | yaYfillgi | yaDfillgi |
| HE3202 | AKR1C4 | 10 | 52550564 | G | A | A2403,A3201,B3801,B4101,C1203,C1701 | A2403 | 28 | 165 | rvqlqLgvv | rvqloRgvv |
| HE3202 | AKR1C4 | 10 | 52550564 | G | A | A2403,A3201,B3801,B4101,C1203,C1701 | C1203 | 359 | 13420 | iairvqLqL | iairvqlqR |
| HE3202 | AKR1C4 | 10 | 52550564 | G | G | A2403,A3201,B3801,B4101,C1203,C1701 | C1203 | 14 | 10 | yqLqLgvvv | yqlqRgvvv |
| HE3202 | ALOX5 | 10 | 459363007 | C | G | A2403,A3201,B3801,B4101,C1203,C1701 | A3201 | 452 | 16 | Gthvsevf | Rthvsevf |
| HE3202 | NMDIC | 10 | 649673881 | G | A | A2403,A3201,B3801,B4101,C1203,C1701 | C1203 | 161 | 30 | eagQtgrii | eagEtgrii |
| HE3202 | CTNNA3 | 10 | 682803419 | G | G | A2403,A3201,B3801,B4101,C1203,C1701 | C1203 | 117 | 13 | eVvdditsi | eAvdditsi |
| HE3202 | CDH23 | 10 | 734983312 | G | T | A2403,A3201,B3801,B4101,C1203,C1701 | A3201 | 329 | 1835 | fkzYsavsi | fksDsavsi |

| | | | | | | | | |
|---|---|---|---|---|---|---|---|---|
| HE3202 | ADAMTS16 | 5 | 5187592 | G | A | A2403,A3201,B3801,B4101,C1203,C1701 | C1203 | 160 | 73 | iasigHit | iaiVgfiit |
| HE3202 | DNAH5 | 5 | 137083315 | C | T | A2403,A3201,B3801,B4101,C1203,C1701 | A3201 | 217 | 1478 | klaiNgtii | klaiOggtii |
| HE3202 | DNAH5 | 5 | 137083315 | C | T | A2403,A3201,B3801,B4101,C1203,C1701 | C1203 | 14 | 9 | iaiNgtiirn | iaiDgstirn |
| HE3202 | C6 | 5 | 41149516 | T | G | A2403,A3201,B3801,B4101,C1203,C1701 | A2403 | 5 | 6 | yftspacTf | yftspackf |
| HE3202 | C6 | 5 | 41149516 | T | G | A2403,A3201,B3801,B4101,C1203,C1701 | C1203 | 239 | 1168 | yftspacTf | yftspackf |
| HE3202 | C6 | 5 | 41149516 | T | G | A2403,A3201,B3801,B4101,C1203,C1701 | C1203 | 54 | 47 | ftspacTfi | ftspackfi |
| HE3202 | ADAMTS6 | 5 | 645213084 | C | A | A2403,A3201,B3801,B4101,C1203,C1701 | C1203 | 65 | 49 | fyterSpav | fyterApav |
| HE3202 | ADAMTS6 | 5 | 64521384 | C | A | A2403,A3201,B3801,B4101,C1203,C1701 | C1203 | 14 | 13 | yterSpavi | yterApavi |
| HE3202 | MAP1B | 5 | 71495226 | C | A | A2403,A3201,B3801,B4101,C1203,C1701 | C1203 | 424 | 1141 | Rstpesegy | Tstpesegy |
| HE3202 | VTA0C2 | 5 | 112899315 | G | A | A2403,A3201,B3801,B4101,C1203,C1701 | A3201 | 294 | 194 | aHtrafqaw | altrafqaw |
| HE3202 | HSPA4 | 5 | 132432907 | A | T | A2403,A3201,B3801,B4101,C1203,C1701 | C1203 | 99 | 91 | daknSweey | daknAveeey |
| HE3202 | PCDHGB3 | 5 | 140751565 | G | A | A2403,A3201,B3801,B4101,C1203,C1701 | B3801 | 84 | 570 | aRdqgspti | aRdqgspti |
| HE3202 | PCDHGB3 | 5 | 140751565 | G | A | A2403,A3201,B3801,B4101,C1203,C1701 | C1203 | 383 | 560 | qaHdqgsap | qaRdqggspi |
| HE3202 | NDST1 | 5 | 149803856 | G | C | A2403,A3201,B3801,B4101,C1203,C1701 | A2403 | 384 | 151 | hLspqavif | nVspqavif |
| HE3202 | NMUR2 | 5 | 151784173 | C | A | A2403,A3201,B3801,B4101,C1203,C1701 | A2403 | 213 | 119 | rlCivwgf | rlKGivwgf |
| HE3202 | NMUR2 | 5 | 151784173 | C | A | A2403,A3201,B3801,B4101,C1203,C1701 | C1203 | 11 | 5 | rlCivwgt | rlKGivwgt |
| HE3202 | NMUR2 | 5 | 151784173 | C | A | A2403,A3201,B3801,B4101,C1203,C1701 | C1203 | 21 | 18 | ratriiGiv | ratriiGiv |
| HE3202 | MAT2B | 5 | 162343662 | A | T | A2403,A3201,B3801,B4101,C1203,C1701 | C1203 | 275 | 4365 | Fakeaaavg | Lakeaaavg |
| HE3202 | ORSV1 | 5 | 293232257 | G | A | A2403,A3201,B3801,B4101,C1203,C1701 | A2403 | 419 | 689 | afEtcashi | afStcashi |
| HE3202 | ORSV1 | 5 | 293232257 | G | A | A2403,A3201,B3801,B4101,C1203,C1701 | C1203 | 91 | 3391 | Ftcashlai | Stcashlai |
| HE3202 | SRPK1 | 5 | 358336878 | G | A | A2403,A3201,B3801,B4101,C1203,C1701 | A3301 | 238 | 3590 | ksMagnflv | ksTaignflv |
| HE3202 | NFKBIE | 6 | 4423322B1 | C | T | A2403,A3201,B3801,B4101,C1203,C1701 | A3201 | 92 | 169 | rlprtTgaw | rlprtrAgaw |
| HE3202 | BAI3 | 6 | 70049281 | C | A | A2403,A3201,B3801,B4101,C1203,C1701 | A2403 | 191 | 189969 | plRaitwrnF | pllaitwrnS |
| HE3202 | BAI3 | 6 | 70049281 | C | A | A2403,A3201,B3801,B4101,C1203,C1701 | A3301 | 247 | 222286 | plRatwrnF | pllaitwrnS |
| HE3202 | BAI3 | 6 | 70049281 | C | A | A2403,A3201,B3801,B4101,C1203,C1701 | C1203 | 57 | 19 | laRwrmFav | laitwrmSav |
| HE3202 | KHDC3L | 6 | 74072827 | G | A | A2403,A3201,B3801,B4101,C1203,C1701 | C1203 | 291 | 818 | rgVeriphv | rgGeriphv |
| HE3202 | MYO6 | 6 | 76550358 | C | T | A2403,A3201,B3801,B4101,C1203,C1701 | C1203 | 97 | 125 | rsCrlgkfv | rsSrlgkfv |
| HE3202 | MRAP2 | 6 | 847726771 | A | G | A2403,A3201,B3801,B4101,C1203,C1701 | A2403 | 107 | 41 | ifmffvlAi | ifmffvlTi |
| HE3202 | MRAP2 | 6 | 847726771 | A | G | A2403,A3201,B3801,B4101,C1203,C1701 | C1203 | 37 | 36 | fmffvlAii | fmffvlTii |
| HE3202 | MYCT1 | 6 | 153042915 | C | A | A2403,A3201,B3801,B4101,C1203,C1701 | A2403 | 62 | 174415 | tWkiggfi | lGivkggfi |
| HE3202 | MYCL1 | 6 | 153042915 | C | A | A2403,A3201,B3801,B4101,C1203,C1701 | C1203 | 362 | 318 | vsrmaiWlvl | vsrmaiGlvl |
| HE3202 | FRMD1 | 6 | 168457910 | A | T | A2403,A3201,B3801,B4101,C1203,C1701 | C1203 | 386 | 1675 | tshNfhrai | tshTfhrai |
| HE3202 | SDK1 | 7 | 4091415 | C | T | A2403,A3201,B3801,B4101,C1203,C1701 | A3201 | 109 | 2588 | svlcfttpV | svlcfttpG |
| HE3202 | SDK1 | 7 | 4091415 | C | T | A2403,A3201,B3801,B4101,C1203,C1701 | A3201 | 117 | 20055 | svlcfttpV | svlcfttpG |
| HE3202 | FBXL18 | 7 | 5545059 | T | A | A2403,A3201,B3801,B4101,C1203,C1701 | C1203 | 88 | 62 | ksiihSvit | ksiihTvit |
| HE3202 | TNS07A | 7 | 116762273 | C | A | A2403,A3201,B3801,B4101,C1203,C1701 | C1203 | 282 | 10268 | iqkdktipV | iqkdktipA |
| HE3202 | DNAH11 | 7 | 216603848 | A | T | A2403,A3201,B3801,B4101,C1203,C1701 | C1203 | 17 | 19 | ylroIWrhii | ylrpIRrhii |
| HE3202 | DNAH11 | 7 | 216573374 | C | A | A2403,A3201,B3801,B4101,C1203,C1701 | A2403 | 39 | 39 | hwoDqtlenkai | hwHtjenkai |
| HE3202 | DNAH11 | 7 | 216573375 | T | A | A2403,A3201,B3801,B4101,C1203,C1701 | A2403 | 95 | 39 | hwHtLhmka | hwhQlrnka |
| HE3202 | OSBPL3 | 7 | 24874137 | C | A | A2403,A3201,B3801,B4101,C1203,C1701 | A3301 | 89 | 777 | kSaqipspi | kAaqipspi |
| HE3202 | OSBPL3 | 7 | 24874138 | C | G | A2403,A3201,B3801,B4101,C1203,C1701 | C1203 | 311 | 676 | elBdNaaaqi | eMoKaaaai |
| HE3202 | OSBPL3 | 7 | 24874138 | C | A | A2403,A3201,B3801,B4101,C1203,C1701 | C1203 | 64 | 76 | Naaaqipspi | Kaaaqipspi |
| HE3202 | LSM5 | 7 | 32527311 | T | A | A2403,A3201,B3801,B4101,C1203,C1701 | A3201 | 174 | 1465 | qilngYni | qilngNni |
| HE3202 | LSM5 | 7 | 32527311 | C | A | A2403,A3201,B3801,B4101,C1203,C1701 | C1203 | 122 | 2148 | ngYnitmlv | ngNnitmlv |
| HE3202 | HECW1 | 7 | 43400557 | C | G | A2403,A3201,B3801,B4101,C1203,C1701 | A3201 | 40 | 1861 | Rvknsaapi | Tvknsaapi |
| HE3202 | HECW1 | 7 | 43400557 | C | G | A2403,A3201,B3801,B4101,C1203,C1701 | C1203 | 88 | 16 | rattpsvRv | rattpsvTv |
| HE3202 | HECW1 | 7 | 45938465 | C | A | A2403,A3201,B3801,B4101,C1203,C1701 | C1203 | 127 | 295 | RvknsaapI | Tvknsaapi |
| HE3202 | IGFBP1 | 7 | 45938465 | A | A | A2403,A3201,B3801,B4101,C1203,C1701 | C1203 | 341 | 1629 | lplgaarSv | lplgaarGv |
| HE3202 | VSTM2A | 7 | 54617773 | A | T | A2403,A3201,B3801,B4101,C1203,C1701 | C1203 | 431 | 272 | vsaaipCsi | vsaaipSsi |

| | | | | | | | | |
|---|---|---|---|---|---|---|---|---|
| M4945 | CHST15 | 10 | 125804291 | C | T | A0201,A3001,B1302,B4403,C0602,C1602 | A3001 | 115 | 282 | rstfdTlrk | rstfdAlrk |
| M4945 | TCERG1L | 10 | 132915093 | G | T | A0201,A3001,B1302,B4403,C0602,C1602 | A3001 | 267 | 1178 | rvNhfrdml | rvThfrdml |
| M4945 | TCERG1L | 10 | 132915093 | G | T | A0201,A3001,B1302,B4403,C0602,C1602 | C0602 | 227 | 618 | ervNhfrdm | ervThfrdm |
| M4945 | TUBGCP2 | 10 | 135107198 | C | A | A0201,A3001,B1302,B4403,C0602,C1602 | A0201 | 119 | 255936 | gMyvsaqpl | gRyvsaqpl |
| M4945 | TUBGCP2 | 10 | 135107198 | C | A | A0201,A3001,B1302,B4403,C0602,C1602 | A3001 | 242 | 43 | Myvsaqpla | Ryvsaqpla |
| M4945 | CTSD | 11 | 1782696 | A | G | A0201,A3001,B1302,B4403,C0602,C1602 | A3001 | 312 | 371 | alvrTplhk | alvrlplhk |
| M4945 | PRKCDBP | 11 | 6341559 | C | T | A0201,A3001,B1302,B4403,C0602,C1602 | A3001 | 338 | 89 | larrKgglg | larrCgglg |
| M4945 | DCHS1 | 11 | 6645605 | A | C | A0201,A3001,B1302,B4403,C0602,C1602 | A0201 | 44 | 38 | tftMvgtv | tftMvgtv |
| M4945 | DCHS1 | 11 | 6645605 | A | C | A0201,A3001,B1302,B4403,C0602,C1603 | A0201 | 30 | 139 | ftMvgtval | ftlvgtval |
| M4945 | OR10A2 | 11 | 6891025 | G | C | A0201,A3001,B1302,B4403,C0602,C1602 | A0203 | 58 | 54 | sltfith | siLfith |
| M4945 | OR10A2 | 11 | 6891025 | G | C | A0201,A3001,B1302,B4403,C0602,C1602 | B4403 | 125 | 62 | teigsltfi | teigsltfi |
| M4945 | RBMXL2 | 11 | 7110583 | C | A | A0201,A3001,B1302,B4403,C0602,C1602 | A0203 | 17 | 39 | sldgkTikv | sldgkAikv |
| M4945 | RBMXL2 | 11 | 7110583 | C | A | A0201,A3001,B1302,B4403,C0602,C1602 | A3001 | 162 | 65 | kslldgkTik | kslldgkAik |
| M4945 | OR10A3 | 11 | 7960556 | G | A | A0201,A3001,B1302,B4403,C0602,C1602 | A3001 | 39 | 9 | Tikvaqatk | Aikvaqatk |
| M4945 | PARVA | 11 | 12495317 | G | A | A0201,A3001,B1302,B4403,C0602,C1602 | C0602 | 179 | 17362 | gHnemhlf | gPnemhlf |
| M4945 | TPM1 | 11 | 180423598 | A | T | A0201,A3001,B1302,B4403,C0602,C1602 | A0201 | 276 | 22 | gmaintpl | gMnaintpl |
| M4945 | F2 | 11 | 46741289 | G | C | A0201,A3001,B1302,B4403,C0602,C1602 | A0201 | 38 | 145 | amnelLhdl | amnelLhdl |
| M4945 | MYBPC3 | 11 | 47357495 | C | T | A0201,A3001,B1302,B4403,C0602,C1602 | A3003 | 425 | 620 | rsilHvrr | rsilQvrr |
| M4945 | OR52 | 11 | 579708397 | T | C | A0201,A3001,B1302,B4403,C0602,C1602 | A3003 | 411 | 1598 | slkCrpper | slkWrpper |
| M4945 | MTL5 | 11 | 68517702 | A | G | A0201,A3001,B1302,B4403,C0602,C1602 | A3001 | 95 | 221 | kwkafsAcg | kwkafsTcg |
| M4945 | MRGPRF | 11 | 68772877 | G | T | A0201,A3001,B1302,B4403,C0602,C1602 | A3003 | 327 | 144 | avlpigaRv | avlpigaWv |
| M4945 | SLC36A4 | 11 | 92859342 | T | A | A0201,A3001,B1302,B4403,C0602,C1602 | A0201 | 17 | 26 | Wlweplrw | Rlweplrw |
| M4945 | MFRP | 11 | 119215467 | T | G | A0201,A3001,B1302,B4403,C0602,C1602 | A0201 | 119 | 205 | tlvtlaSl | tlvvtlaTl |
| M4945 | CHD4 | 12 | 6711546 | C | C | A0201,A3001,B1302,B4403,C0602,C1602 | B4403 | 328 | 40741 | rEscahdef | rGscahdef |
| M4945 | CHD4 | 12 | 6711546 | C | C | A0201,A3001,B1302,B4403,C0602,C1602 | A3001 | 14 | 112 | lsskrqkMer | lsskrqkKer |
| M4945 | CHD4 | 12 | 6711546 | C | C | A0201,A3001,B1302,B4403,C0602,C1602 | A3001 | 20 | 27 | rqkMermli | rqkKermli |
| M4945 | FAM222A | 12 | 110206690 | A | A | A0201,A3001,B1302,B4403,C0602,C1602 | C0602 | 306 | 206 | krqkMermi | krqkKermi |
| M4945 | MPHOSPH9 | 12 | 123661241 | T | T | A0201,A3001,B1302,B4403,C0602,C1602 | B4403 | 187 | 282 | peacggllay | peacggRay |
| M4945 | MPHOSPH9 | 12 | 123661241 | T | T | A0201,A3001,B1302,B4403,C0602,C1602 | A3001 | 21 | 66 | rihvrpsHa | rihvrpsRa |
| M4945 | MPHOSPH9 | 12 | 123661241 | T | T | A0201,A3001,B1302,B4403,C0602,C1602 | A3001 | 19 | 17 | hvrpsHant | hvrpsKant |
| M4945 | ZNF268 | 12 | 133779594 | G | A | A0201,A3001,B1302,B4403,C0602,C1602 | C0602 | 20 | 45 | vrpsHanrt | vrpsRanrt |
| M4945 | ZNF268 | 12 | 133779594 | G | A | A0201,A3001,B1302,B4403,C0602,C1602 | A3001 | 7 | 6 | hqrthtgSk | hqrthtgFk |
| M4945 | ZNF268 | 12 | 133779594 | G | A | A0201,A3001,B1302,B4403,C0602,C1602 | A3003 | 22 | 104 | rthgGkpy | rthgEkpy |
| M4945 | PSPC1 | 13 | 20277431 | T | G | A0201,A3001,B1302,B4403,C0602,C1602 | C0602 | 234 | 209 | thgGkpyv | thgEkpyv |
| M4945 | PSPC1 | 13 | 20277431 | T | G | A0201,A3001,B1302,B4403,C0602,C1602 | A3001 | 204 | 332 | rtgsKtpqa | rtgsEtpqa |
| M4945 | PCCA | 13 | 100807336 | G | G | A0201,A3001,B1302,B4403,C0602,C1602 | A3004 | 243 | 10951 | gsKtpqapm | gsEtpqapm |
| M4945 | MYO16 | 13 | 109859063 | C | A | A0201,A3001,B1302,B4403,C0602,C1602 | A3001 | 152 | 61 | aikktMaqa | aikktRaqa |
| M4945 | ACOT1 | 14 | 74064385 | A | A | A0201,A3001,B1302,B4403,C0602,C1602 | A0201 | 63 | 67 | ifhHaeprv | ifhHaeprv |
| M4945 | IDHAL6B | 15 | 59498231 | T | C | A0201,A3001,B1302,B4403,C0602,C1602 | A0201 | 338 | 668 | aiepGkpw | aiepLkptv |
| M4945 | SCAPER | 15 | 77021077 | A | A | A0201,A3001,B1302,B4403,C0602,C1602 | A3001 | 187 | 2937 | gmakrpaqa | gmakrpRqa |
| M4945 | SLC28A1 | 15 | 85461805 | C | G | A0201,A3001,B1302,B4403,C0602,C1602 | A3003 | 154 | 8449 | qArkalea | qErkalea |
| M4945 | SLC28A1 | 15 | 85461805 | C | G | A0201,A3001,B1302,B4403,C0602,C1602 | A0201 | 27 | 21 | cvisvlyAv | cvisvlyAv |
| M4945 | GFER | 16 | 2034898 | A | A | A0201,A3001,B1302,B4403,C0602,C1602 | A0203 | 12 | 6057 | yQvgImqwv | yHvglmqwv |
| M4945 | GFER | 16 | 2034898 | A | A | A0201,A3001,B1302,B4403,C0602,C1602 | A0203 | 270 | 247 | hlfPKtvpc | hlfSKtvpc |
| M4945 | SMG1 | 16 | 18875348 | G | C | A0201,A3001,B1302,B4403,C0602,C1602 | A3001 | 46 | 97 | aqtilHlPk | aqtilHlPk |
| M4945 | EARS2 | 16 | 23568528 | G | G | A0201,A3001,B1302,B4403,C0602,C1602 | A3004 | 7 | 13 | agrnsSspk | agrnsAspk |
| M4945 | CBLN1 | 16 | 49315370 | G | G | A0201,A3001,B1302,B4403,C0602,C1602 | A3003 | 3 | 10 | rvrfapssI | rvrfapssT |
| M4945 | TAT | 16 | 71607468 | A | A | A0201,A3001,B1302,B4403,C0602,C1602 | A0201 | 174 | 138 | mICvlelli | mIGvlelli |
| M4945 | | | | | | A0201,A3001,B1302,B4403,C0602,C1602 | A3001 | 22 | 127 | asyyhCpea | asyyhEpea |

Figure 21 (Cont.)

| | | | | | | | | |
|---|---|---|---|---|---|---|---|---|
| M4945 | TAT | 16 | 71607468 | A | G | A0201,A3001,B1302,B4403,C0602,C1602 | B4403 | 453 | 719 | eeiasyyhR | eeiasyyhC |
| M4945 | GSG2 | 17 | 3627461 | C | T | A0201,A3001,B1302,B4403,C0602,C1602 | A0301 | 25 | 84 | rWrrrrpgg | rRrrrrpgg |
| M4945 | DLG4 | 17 | 7099591 | C | T | A0201,A3001,B1302,B4403,C0602,C1602 | A0201 | 26 | 48 | sfSsgtasf | sfGsgtasf |
| M4945 | KRBA2 | 17 | 8273015 | C | A | A0201,A3001,B1302,B4403,C0602,C1602 | A0201 | 10 | 53 | kqahevvfsv | kqahevvfsv |
| M4945 | TRIM16 | 17 | 15539387 | C | G | A0201,A3001,B1302,B4403,C0602,C1602 | A0201 | 18 | 17 | Tmaaisntv | fimaaisntv |
| M4945 | C17orf75 | 17 | 30661839 | A | T | A0201,A3001,B1302,B4403,C0602,C1602 | A0201 | 28 | 22 | afsytgAev | afsytpVev |
| M4945 | PLEKHM1 | 17 | 43553058 | C | G | A0201,A3001,B1302,B4403,C0602,C1602 | B4403 | 205 | 435 | selehttH | selehttV |
| M4945 | HTBD17 | 17 | 72353187 | C | T | A0201,A3001,B1302,B4403,C0602,C1602 | A3001 | 9 | 129 | aSrvtwwrv | aSrvtwwrv |
| M4945 | FASN | 17 | 80042541 | C | T | A0201,A3001,B1302,B4403,C0602,C1602 | A3003 | 162 | 384 | ltrAdissi | ltrGdissi |
| M4945 | FASN | 17 | 80043708 | C | G | A0201,A3001,B1302,B4403,C0602,C1602 | A3001 | 16 | 10 | hlysripCl | hlysripGl |
| M4945 | FASN | 17 | 80043708 | C | A | A0201,A3001,B1302,B4403,C0602,C1602 | A0201 | 146 | 65 | Cilsphgtl | Gilsphpll |
| M4945 | PIGN | 18 | 59751795 | G | T | A0201,A3001,B1302,B4403,C0602,C1602 | A0201 | 25 | 17 | ftvfsHfm | ftvfsPfm |
| M4945 | PIGN | 18 | 59751795 | G | T | A0201,A3001,B1302,B4403,C0602,C1602 | C0602 | 113 | 12595 | sHfmmgaln | sPfmmgafm |
| M4945 | SALL3 | 18 | 76754149 | G | C | A0201,A3001,B1302,B4403,C0602,C1602 | A3001 | 426 | 1315 | rafttkCai | rafttkGni |
| M4945 | TPGS1 | 19 | 507657 | G | A | A0201,A3001,B1302,B4403,C0602,C1602 | A0301 | 88 | 75 | miraTHkv | mlraAlikv |
| M4945 | TPGS1 | 19 | 507657 | G | A | A0201,A3001,B1302,B4403,C0602,C1602 | A3001 | 62 | 29 | mlraEHkv | mlraAlikv |
| M4945 | HNHA1 | 19 | 1081824 | G | A | A0201,A3001,B1302,B4403,C0602,C1602 | A3001 | 109 | 98 | rtkDkyrvn | rtkGiyrvn |
| M4945 | SBNO2 | 19 | 1122195 | C | A | A0201,A3001,B1302,B4403,C0602,C1602 | C0602 | 84 | 88 | Hhrtrlrqi | Qhrvlrqi |
| M4945 | APC2 | 19 | 1456130 | G | G | A0201,A3001,B1302,B4403,C0602,C1602 | A0201 | 444 | 465 | eMeaqotQv | eMeaqotRv |
| M4945 | PTPRS | 19 | 5240291 | A | A | A0201,A3001,B1302,B4403,C0602,C1602 | A3001 | 302 | 1204 | itisRspor | itisWsppr |
| M4945 | PTPRS | 19 | 5240281 | A | T | A0201,A3001,B1302,B4403,C0602,C1602 | B4403 | 470 | 5 | setsHsR | setsHsW |
| M4945 | MLLT1 | 19 | 6222259 | T | T | A0201,A3001,B1302,B4403,C0602,C1602 | A3001 | 353 | 207 | rtssssT | rtssssfS |
| M4945 | DENND1C | 19 | 6471495 | G | A | A0201,A3001,B1302,B4403,C0602,C1602 | A0201 | 192 | 1606 | fiueaWieke | fiueafieki |
| M4945 | SMARCA4 | 19 | 11144372 | C | G | A0201,A3001,B1302,B4403,C0602,C1602 | A0201 | 51 | 51 | iliaaGkyki | itaaAkyal |
| M4945 | SMARCA4 | 19 | 11144372 | C | G | A0201,A3001,B1302,B4403,C0602,C1602 | A3001 | 12 | 13 | kilaaGkyk | kilaaAkyk |
| M4945 | BRD4 | 19 | 15336236 | G | A | A0201,A3001,B1302,B4403,C0602,C1602 | A3001 | 165 | 341 | ksLpppfla | kSpppfla |
| M4945 | MAST3 | 19 | 18246536 | C | T | A0201,A3001,B1302,B4403,C0602,C1602 | A3001 | 109 | 1635 | rlrqspV | rllrqspID |
| M4945 | GRAMD1A | 19 | 35504236 | A | A | A0201,A3001,B1302,B4403,C0602,C1602 | A0203 | 99 | 1021 | itsedVdyv | itsedEdyv |
| M4945 | LGI4 | 19 | 33624949 | G | T | A0201,A3001,B1302,B4403,C0602,C1602 | A0201 | 417 | 532 | firipFlht | firipSIhi |
| M4945 | LGI4 | 19 | 35624949 | G | A | A0201,A3001,B1302,B4403,C0602,C1602 | A3201 | 458 | 2336 | fthiilfts | Slthiifts |
| M4945 | LGI4 | 19 | 35624949 | G | A | A0201,A3001,B1302,B4403,C0602,C1602 | C0602 | 115 | 470 | igsfinpH | gsfiripSl |
| M4945 | LGI4 | 19 | 35624949 | G | A | A0201,A3001,B1302,B4403,C0602,C1602 | A3001 | 37 | 32 | lrlpFihl | lrlpSthH |
| M4945 | NUMBL | 19 | 41183182 | A | T | A0201,A3001,B1302,B4403,C0602,C1602 | A3001 | 454 | 1324 | sfrsRggr | sfrlsGggr |
| M4945 | NUMBL | 19 | 41183182 | A | T | A0201,A3001,B1302,B4403,C0602,C1602 | A3093 | 480 | 1218 | rlsRggrpa | rlsSzggrpa |
| M4945 | ZC3H4 | 19 | 47575370 | C | A | A0201,A3001,B1302,B4403,C0602,C1602 | A3001 | 79 | 108 | gvrfpVpgg | gvrfpGIpgg |
| M4945 | PPFIA3 | 19 | 49637375 | T | A | A0201,A3001,B1302,B4403,C0602,C1602 | A2201 | 82 | 78 | lisesneCl | iisesheRI |
| M4945 | PPFIA3 | 19 | 50910042 | G | G | A0201,A3001,B1302,B4403,C0602,C1602 | B4403 | 494 | 825 | sesneCkqi | sesrieRlqi |
| M4945 | POLD1 | 19 | 50910042 | A | A | A0201,A3001,B1302,B4403,C0602,C1602 | A3001 | 482 | 215 | rvpyvVsa | rvpyvilsa |
| M4945 | VN1R2 | 19 | 53762460 | T | A | A0201,A3001,B1302,B4403,C0602,C1602 | A0201 | 19 | 25 | lmfwassss | lmfwassss |
| M4945 | ZNF813 | 19 | 53984247 | T | A | A0201,A3001,B1302,B4403,C0602,C1602 | A3001 | 148 | 122 | kvhnQkrni | kvfnRkrni |
| M4945 | NLRP12 | 19 | 54310777 | A | T | A0201,A3001,B1302,B4403,C0602,C1602 | A3003 | 384 | 504 | gHYpackl | gsHpackl |
| M4945 | TMEM86B | 19 | 55749559 | A | A | A0201,A3001,B1302,B4403,C0602,C1602 | A0201 | 322 | 392 | fvpCmaafa | fvpGmaafa |
| M4945 | CCDC106 | 19 | 56162828 | T | C | A0201,A3001,B1302,B4403,C0602,C1602 | A3001 | 242 | 266 | gasrrrVgk | gasrrrFgk |
| M4945 | CCDC106 | 19 | 56162828 | T | C | A0201,A3001,B1302,B4403,C0602,C1602 | A3001 | 85 | 33 | srrrrVgkpk | srrrFgkpk |
| M4945 | CCDC106 | 19 | 56162828 | C | C | A0201,A3001,B1302,B4403,C0602,C1602 | A3001 | 191 | 190 | rrrVgkpka | rrrFgkpka |
| M4945 | TPO | 2 | 1500454 | G | G | A0201,A3001,B1302,B4403,C0602,C1602 | A0201 | 496 | 4647 | ysFrhgyet | ysCrhgyet |
| M4945 | TPO | 2 | 1500454 | C | C | A0201,A3001,B1302,B4403,C0602,C1602 | C0602 | 64 | 387 | ysFrhgyet | ysCrhgyet |
| M4945 | MYCN | 2 | 16082407 | C | C | A0201,A3001,B1302,B4403,C0602,C1602 | C0602 | 35 | 10653 | eRpswoteen | ePpswocen |
| M4945 | MPV17 | 2 | 27534910 | C | G | A0201,A3001,B1302,B4403,C0602,C1602 | A0201 | 11 | 6 | vlwpPvqta | ylwpAvqta |

Figure 21 (Cont.)

| | | | | | | | | | | |
|---|---|---|---|---|---|---|---|---|---|---|
| M4945 | REG3A | 2 | 79385917 | T | C | A0201,A3001,B1302,B4403,C0602,C1602 | A3001 | 47 | 13 | kaygshcCa | kaygshcYa |
| M4945 | REG3A | 2 | 79385817 | T | C | A0201,A3001,B1302,B4403,C0602,C1602 | A3003 | 86 | 25 | gshcCalH | gshcYalH |
| M4945 | SFT2D3 | 2 | 128459121 | C | A | A0201,A3001,B1302,B4403,C0602,C1602 | C0602 | 351 | 225 | lhrKlqeyi | lhrQlqeyi |
| M4945 | LRP1B | 2 | 141751663 | A | T | A0201,A3001,B1302,B4403,C0602,C1602 | A3001 | 82 | 11321 | kfrcknrhc | kfrcknrhc |
| M4945 | EVX2 | 2 | 176945475 | C | G | A0201,A3001,B1302,B4403,C0602,C1602 | A0201 | 85 | 122 | vtyTrnthaa | vtyMnthaa |
| M4945 | FAM171B | 2 | 187605158 | C | A | A0201,A3001,B1302,B4403,C0602,C1602 | A3001 | 226 | 712 | vvitAlpwk | vvitPlpwk |
| M4945 | PRR21 | 2 | 240582003 | T | G | A0201,A3001,B1302,B4403,C0602,C1602 | C6602 | 137 | 232 | vhassptSi | vhassptAi |
| M4945 | TGM3 | 20 | 2320540 | A | A | A0201,A3001,B1302,B4403,C0602,C1602 | A3001 | 17 | 41 | rvrkpvnvR | rvrkpvnvQ |
| M4945 | TGM3 | 20 | 2320540 | A | T | A0201,A3001,B1302,B4403,C0602,C1602 | C0602 | 241 | 181 | vrkpvnvRm | vrkpvnvQm |
| M4945 | INSM1 | 20 | 20348328 | C | G | A0201,A3001,B1302,B4403,C0602,C1602 | A3001 | 249 | 133 | rgfQxkrsk | rgfLvkrsk |
| M4945 | LAMA5 | 20 | 60905564 | C | A | A0201,A3001,B1302,B4403,C0602,C1602 | A0201 | 45 | 735 | atlvftthw | atvvftthv |
| M4945 | LAMA5 | 20 | 60905564 | C | T | A0201,A3001,B1302,B4403,C0602,C1602 | A3003 | 117 | 582 | atlvftthv | atvvftthv |
| M4945 | LAMA5 | 20 | 60905564 | G | T | A0201,A3001,B1302,B4403,C0602,C1602 | C0602 | 91 | 110 | lrepaiaRv | lrepaiaRv |
| M4945 | RBBP8NL | 20 | 60991911 | C | G | A0201,A3001,B1302,B4403,C0602,C1602 | A0201 | 384 | 3816 | gRvdrcmvt | gICdrcmvt |
| M4945 | RBBP8NL | 20 | 60991911 | G | C | A0201,A3001,B1302,B4403,C0602,C1602 | A3001 | 312 | 147 | rtragPtdr | rltagIcdr |
| M4945 | NPBWR2 | 20 | 62737553 | A | A | A0201,A3001,B1302,B4403,C0602,C1602 | A2001 | 426 | 2000 | quvdkVsrv | quvfkAnv |
| M4945 | NPBWR2 | 20 | 62737553 | A | G | A0201,A3001,B1302,B4403,C0602,C1602 | A0201 | 315 | 2318 | kVsrvytlv | kAsrvytlv |
| M4945 | NPBWR2 | 20 | 62737553 | A | G | A0201,A3001,B1302,B4403,C0602,C1602 | A3003 | 107 | 443 | kVsrvytlv | kAsrvytlv |
| M4945 | NPBWR2 | 20 | 62737553 | A | T | A0201,A3001,B1302,B4403,C0602,C1602 | A3001 | 55 | 11 | Vsrvytvl | Asrvytvl |
| M4945 | NPBWR2 | 20 | 62737553 | A | G | A0201,A3001,B1302,B4403,C0602,C1602 | C0602 | 274 | 215 | fkVsrvytl | fkAsrvytl |
| M4945 | XKR3 | 22 | 17288312 | G | G | A0201,A3001,B1302,B4403,C0602,C1602 | B4403 | 28 | 34 | gevafAlvm | gevafGlvm |
| M4945 | SMTN | 22 | 31487823 | T | T | A0201,A3001,B1302,B4403,C0602,C1602 | A3001 | 5 | 13 | ssrggFsik | ssrggCsik |
| M4945 | SH3BP1 | 22 | 38044382 | C | C | A0201,A3001,B1302,B4403,C0602,C1602 | A0201 | 14 | 69 | kmTpsnriai | kmTpsniai |
| M4945 | SH3BP1 | 22 | 38044382 | C | C | A0201,A3001,B1302,B4403,C0602,C1602 | A3001 | 85 | 403 | mIpsniav | mTpsniavv |
| M4945 | SH3BP1 | 22 | 38044382 | C | A | A0201,A3001,B1302,B4403,C0602,C1602 | A3001 | 269 | 399 | kmIpsniai | kmTpsniai |
| M4945 | FANCD2 | 3 | 10122824 | A | G | A0201,A3001,B1302,B4403,C0602,C1602 | C0602 | 175 | 8806 | qRrsaqeiv | qQrsaqeiv |
| M4945 | XPC | 3 | 14139348 | T | G | A0201,A3001,B1302,B4403,C0602,C1602 | A3001 | 4 | 4 | rtkaRsksa | rtkaGsksa |
| M4945 | XPC | 3 | 14139348 | C | A | A0201,A3001,B1302,B4403,C0602,C1602 | A3001 | 19 | 5121 | kaRsksasr | kaGsksasr |
| M4945 | XPC | 3 | 14139348 | C | T | A0201,A3001,B1302,B4403,C0602,C1602 | A3001 | 66 | 1305 | Rsksasrth | Gsksasrth |
| M4945 | DNAH1 | 3 | 52415830 | C | A | A0201,A3001,B1302,B4403,C0602,C1602 | A3001 | 11 | 14 | htrlashma | ltrlashma |
| M4945 | APPL1 | 3 | 57294666 | C | A | A0201,A3001,B1302,B4403,C0602,C1602 | A3001 | 141 | 172 | vtrltfpIr | vtrltfpIr |
| M4945 | APPL1 | 3 | 57294666 | C | G | A0201,A3001,B1302,B4403,C0602,C1602 | A3001 | 16 | 12559 | pIRcvdya | pIPcvdya |
| M4945 | C3orf58 | 3 | 143691263 | A | T | A0201,A3001,B1302,B4403,C0602,C1602 | A0201 | 55 | 35 | ImvPnspsl | ImvLhspsl |
| M4945 | CCDC39 | 3 | 180370000 | G | T | A0201,A3001,B1302,B4403,C0602,C1602 | A0201 | 201 | 5605 | alWkniski | alfkniski |
| M4945 | TMEM129 | 4 | 1719912 | C | T | A0201,A3001,B1302,B4403,C0602,C1602 | A0201 | 87 | 135 | rvaMtnpav | rvaStnpav |
| M4945 | TMEM129 | 4 | 1719912 | T | C | A0201,A3001,B1302,B4403,C0602,C1602 | A0201 | 65 | 101 | rvaMtnpav | rvaStnpav |
| M4945 | ACOX3 | 4 | 8417530 | C | C | A0201,A3001,B1302,B4403,C0602,C1602 | A0201 | 298 | 23 | gmyGsskea | gmyDxslaa |
| M4945 | EPHA5 | 4 | 66535423 | C | A | A0201,A3001,B1302,B4403,C0602,C1602 | A3003 | 488 | 136 | agrrLppsg | agrrRppsg |
| M4945 | WDFY3 | 4 | 85707132 | T | A | A0201,A3001,B1302,B4403,C0602,C1602 | A3001 | 14 | 987 | kalakt4gi | kalakt4gi |
| M4945 | SLC39B2 | 4 | 103970081 | A | A | A0201,A3001,B1302,B4403,C0602,C1602 | A0301 | 226 | 9 | llahyHCl | llahyHGl |
| M4945 | TACR3 | 4 | 104511020 | T | T | A0201,A3001,B1302,B4403,C0602,C1602 | A3003 | 26 | 4838 | ssmytvirK | ssmytvtriM |
| M4945 | TACR3 | 4 | 104511020 | A | A | A0201,A3001,B1302,B4403,C0602,C1602 | A3001 | 38 | 19 | vtrKesmtv | vtrMesmtv |
| M4945 | TACR3 | 4 | 104511020 | C | T | A0201,A3001,B1302,B4403,C0602,C1602 | C0602 | 251 | 12 | trKesmtvv | trMesmtvv |
| M4945 | GALNT7 | 4 | 174242777 | G | T | A0201,A3001,B1302,B4403,C0602,C1602 | A0203 | 402 | 24606 | dLsevIhqv | dRsevIhqv |
| M4945 | KIAA0947 | 5 | 5464173 | A | A | A0201,A3001,B1302,B4403,C0602,C1602 | A3001 | 353 | 2312 | ktsassrfe | ktsassrVe |
| M4945 | KIAA0947 | 5 | 5464173 | G | A | A0201,A3001,B1302,B4403,C0602,C1602 | A3001 | 9 | 400 | ssrFethqs | ssrVethqs |
| M4945 | SEMA5A | 5 | 9224935 | G | G | A0201,A3001,B1302,B4403,C0602,C1602 | A3001 | 20 | 33 | marcpyspI | marcpyspQ |
| M4945 | TRIO | 5 | 14461158 | T | A | A0201,A3001,B1302,B4403,C0602,C1602 | A3001 | 40 | 18 | ssnttaNppa | ssnttaSppa |
| M4945 | CDH9 | 5 | 26813369 | G | A | A0201,A3001,B1302,B4403,C0602,C1602 | A0201 | 40 | 76 | slad5kssi | slad5kssi |

| | | | | | | | | | |
|---|---|---|---|---|---|---|---|---|---|
| M4945 | C3MD1 | 8 | 3015437 | G | A | A0201,A3001,B1302,B4403,C0602,C1602 | C0602 | 119 | 134 | rrwnySspl | rrwnySspl |
| M4945 | PCM1 | 8 | 178722255 | C | A | A0201,A3001,B1302,B4403,C0602,C1602 | A3003 | 494 | 7444 | lvHrvkevk | lvHrvkevk |
| M4945 | UBR5 | 8 | 103341409 | G | A | A0201,A3001,B1302,B4403,C0602,C1602 | A3001 | 17 | 5678 | hLratfigi | hPratfigi |
| M4945 | UBR5 | 8 | 103341409 | G | A | A0201,A3001,B1302,B4403,C0602,C1602 | C0602 | 161 | 40 | lhhLiatfi | lhhPratfi |
| M4945 | PHF20L1 | 8 | 133806768 | G | C | A0201,A3001,B1302,B4403,C0602,C1602 | A0201 | 210 | 498 | wiywdsriT | wiywdsnfli |
| M4945 | KCNK9 | 8 | 140630643 | T | A | A0201,A3001,B1302,B4403,C0602,C1602 | A0201 | 257 | 409 | kiaphyHs | kiaphyHts |
| M4945 | KCNK9 | 8 | 140630643 | T | A | A0201,A3001,B1302,B4403,C0602,C1602 | A0201 | 290 | 3413 | yHLsisyki | yHsisyki |
| M4945 | KCNK9 | 8 | 140633648 | C | A | A0201,A3001,B1302,B4403,C0602,C1602 | A3003 | 16 | 12 | hyHLsisyk | hyHksisyk |
| M4945 | ZC3H3 | 8 | 144523122 | C | A | A0201,A3001,B1302,B4403,C0602,C1602 | A3003 | 9 | 14 | rsrvsSshg | rsrvsAshg |
| M4945 | ZC3H3 | 8 | 144523122 | C | A | A0201,A3001,B1302,B4403,C0602,C1602 | A3001 | 382 | 194 | rvsSshgpr | rvsAshgpr |
| M4945 | ZC3H3 | 8 | 144523122 | C | A | A0201,A3001,B1302,B4403,C0602,C1602 | A3001 | 424 | 671 | vsSshgprk | vsAshgprk |
| M4945 | ZNF707 | 8 | 144773874 | A | G | A0201,A3001,B1302,B4403,C0602,C1602 | A3003 | 29 | 82 | vqrgArpga | vqrgPrpga |
| M4945 | PLEC | 8 | 145000009 | T | C | A0201,A3001,B1302,B4403,C0602,C1602 | A0201 | 82 | 26 | rlGevaaal | rlAevaaal |
| M4945 | PDCA0 | 9 | 208851397 | T | C | A0201,A3001,B1302,B4403,C0602,C1602 | A3001 | 101 | 28 | masrgrslk | masrgrsFk |
| M4945 | PDCA0 | 9 | 208851397 | T | C | A0201,A3001,B1302,B4403,C0602,C1602 | A3001 | 125 | 222 | asrgrslkq | asrgrsFkq |
| M4945 | PDCAD | 9 | 208851397 | T | C | A0201,A3001,B1302,B4403,C0602,C1602 | A3001 | 54 | 25 | rslkqtsla | rsFkqtsla |
| M4945 | PDXB2 | 9 | 79634574 | T | A | A0201,A3001,B1302,B4403,C0602,C1602 | A3001 | 49 | 9436 | mSrpgksry | mPrpgksry |
| M4945 | RF27 | 9 | 86530349 | C | A | A0201,A3001,B1302,B4403,C0602,C1602 | A0303 | 3 | 856 | ftdMfgj | ftdMfgK |
| M4945 | RF27 | 9 | 86530349 | C | A | A0201,A3001,B1302,B4403,C0602,C1602 | C0602 | 471 | 15124 | ftdMfgi | ttdMfgK |
| M4945 | GAS1 | 9 | 89561177 | C | T | A0201,A3001,B1302,B4403,C0602,C1602 | C0602 | 163 | 843 | rYdrésrc | rCdrésrc |
| M4945 | GOLGA1 | 9 | 127644196 | T | G | A0201,A3001,B1302,B4403,C0602,C1602 | A3001 | 335 | 10368 | rAkpgnema | rEkpgnema |
| M4945 | GOLGA1 | 9 | 127644196 | T | G | A0201,A3001,B1302,B4403,C0602,C1602 | C0602 | 381 | 450 | vrAkpgpem | vrEkpgpeem |
| M4945 | C9orf50 | 9 | 132377837 | T | C | A0201,A3001,B1302,B4403,C0602,C1602 | A3001 | 165 | 1821 | gsrpcrqrY | gsrpcrqrC |
| M4945 | C9orf50 | 9 | 132377837 | T | C | A0201,A3001,B1302,B4403,C0602,C1602 | A3002 | 39 | 31 | rqrYnfrvr | rqrCpfrvr |
| M4945 | C9orf50 | 9 | 132377837 | T | C | A0201,A3001,B1302,B4403,C0602,C1602 | A3001 | 125 | 1042 | rrpfrvrfa | rCpfrvrfa |
| M4945 | USP20 | 9 | 132625509 | G | T | A0201,A3001,B1302,B4403,C0602,C1602 | C0602 | 117 | 657 | qrYpfrvrf | qrCpfrvrf |
| M4945 | MQSPD2 | 9 | 149102994 | G | A | A0201,A3001,B1302,B4403,C0602,C1602 | C0602 | 138 | 72 | vHtdkkpal | vRtdkkpal |
| M4945 | CTPS2 | X | 16627721 | A | G | A0201,A3001,B1302,B4403,C0602,C1602 | A0201 | 98 | 16 | fqwrkeisi | fqwrkeisV |
| M4945 | CTPS2 | X | 16711499 | C | A | A0201,A3001,B1302,B4403,C0602,C1602 | A0201 | 382 | 234 | vlgHPaat | vlgllLaat |
| M4945 | CCDC120 | X | 48923328 | C | T | A0201,A3001,B1302,B4403,C0602,C1602 | A3001 | 451 | 394 | ihvslvAgl | ihvslvPgl |
| M4945 | AR | X | 66786214 | G | C | A0201,A3001,B1302,B4403,C0602,C1602 | A3001 | 92 | 94 | rsApaspyd | rsApaspyl |
| M4945 | MED12 | X | 70345918 | T | A | A0201,A3001,B1302,B4403,C0602,C1602 | C0602 | 63 | 215 | cryEdlssi | cryGdlssi |
| M4945 | MED12 | X | 70345918 | T | A | A0201,A3001,B1302,B4403,C0602,C1602 | A3001 | 9 | 11 | krrmWpea | krrmRpea |
| M4945 | PABPC5 | X | 90690940 | C | G | A0201,A3001,B1302,B4403,C0602,C1602 | C0602 | 78 | 89 | rrmWpeaf | rrmRpeaf |
| M4945 | PABPC5 | X | 90690940 | C | G | A0201,A3001,B1302,B4403,C0602,C1602 | A0201 | 39 | 140 | raMfyltsa | raLfyltsa |
| M4945 | BHLHB9 | X | 102004593 | G | C | A0201,A3001,B1302,B4403,C0602,C1602 | A3001 | 83 | 139 | raMfyltsa | raLfyltsa |
| M4945 | MORC4 | X | 106242929 | T | C | A0201,A3001,B1302,B4403,C0602,C1602 | A3001 | 111 | 43 | tiwpnaTav | tiwpnaPav |
| M4945 | MORC4 | X | 106242929 | T | C | A0201,A3001,B1302,B4403,C0602,C1602 | A3001 | 30 | 50 | sshtrpLsa | sshtrpLsa |
| M4945 | ATG4A | X | 107381409 | C | T | A0201,A3001,B1302,B4403,C0602,C1602 | A0301 | 4 | 3 | htrpLsaai | htrpLsaia |
| MA7027 | DCX | X | 110574263 | C | T | A0201,A3001,B1302,B4403,C0602,C1602 | A0301 | 98 | 974 | flgFlgdel | flgFlgdel |
| MA7027 | DCX | X | 110574261 | C | A | A0201,A3001,B1302,B4403,C0602,C1602 | A0303 | 33 | 32 | sldenecrt | sldenecrV |
| MA7027 | DCX | X | 110574261 | C | A | A0201,A3001,B1302,B4403,C0602,C1602 | A0201 | 22 | 814 | rLmkgnpsa | rVmkgnpsa |
| MA7027 | TRPC5 | X | 111155699 | G | A | A0201,A3001,B1302,B4403,C0602,C1602 | A3001 | 55 | 10 | rLmkgnpsa | rVmkgnpsa |
| MA7027 | ZCCHC12 | X | 117959993 | G | A | A0201,A3001,B1302,B4403,C0602,C1602 | B4403 | 45 | 36 | venefkaDy | venefkaEy |
| MA7027 | CRCCC | 1 | 17264920 | T | C | A2402,A,B0702,B5108,C0702,C1602 | A0201 | 275 | 2494 | Kvieidstt | Nvieidstt |
| MA7027 | IF16 | 1 | 27992956 | G | A | A2402,A,B0702,B5108,C0702,C1602 | C0702 | 288 | 410 | lrqeqVal | lrqeqAal |
| MA7027 | MPC2 | 1 | 167904989 | A | T | A2402,A,B0702,B5108,C0702,C1602 | B0702 | 490 | 415 | vvigNigal | vvigNigal |
| MA7027 | RPWD2 | 1 | 176054916 | G | C | A2402,A,B0702,B5108,C0702,C1602 | C0702 | 125 | 1635 | rpMynhpag | rpLynhpag |
| MA7027 | | | | | | | | 96 | 361 | yfstrmsri | yfstrmsrl |

| | | | | | | | | | |
|---|---|---|---|---|---|---|---|---|---|
| TU0428 | EPG5 | 18 | 434623397 | A | C | A0101,A0301,B0702,B3501,C0401,C0702 | B0702 | 133 | 22760 | kpplsdrtM | kpplsdrtR |
| TU0428 | EPG5 | 18 | 434623397 | A | C | A0101,A0301,B0702,B3501,C0401,C0702 | B0702 | 391 | 493 | pplsdrtMl | pplsdrtRl |
| TU0428 | SERPINB11 | 18 | 61387277 | T | C | A0101,A0301,B0702,B3501,C0401,C0702 | B3501 | 412 | 740 | sldpssvm | sTldpssvm |
| TU0428 | CDH19 | 18 | 64235895 | A | C | A0101,A0301,B0702,B3501,C0401,C0702 | B0702 | 327 | 11769 | lVaggagstf | lGagagstf |
| TU0428 | CDH19 | 18 | 64235895 | A | C | A0101,A0301,B0702,B3501,C0401,C0702 | B3501 | 18 | 207 | lVaggagstf | lGagagstf |
| TU0428 | MED16 | 19 | 868115 | T | C | A0101,A0301,B0702,B3501,C0401,C0702 | A0301 | 126 | 18836 | rsfdhlhpK | rsfdhlhpE |
| TU0428 | ZBTB7A | 19 | 4054614 | A | A | A0101,A0301,B0702,B3501,C0401,C0702 | B0702 | 383 | 118 | avaaaEaav | avaaaVaav |
| TU0428 | ZBTB7A | 19 | 4054614 | A | A | A0101,A0301,B0702,B3501,C0401,C0702 | B3501 | 417 | 108 | avvaaaEaa | avvaaaVaa |
| TU0428 | CAMSAP3 | 19 | 7677541 | C | C | A0101,A0301,B0702,B3501,C0401,C0702 | C0702 | 334 | 826 | rRdcqqpl | rHdcqqpl |
| TU0428 | MUC16 | 19 | 9061111 | T | T | A0101,A0301,B0702,B3501,C0401,C0702 | B0702 | 92 | 140 | tpltAqsa | tpltAgsa |
| TU0428 | MUC16 | 19 | 9061111 | T | T | A0101,A0301,B0702,B3501,C0401,C0702 | B3501 | 206 | 543 | ltAqgsaem | ltTqgsaem |
| TU0428 | MUC16 | 19 | 9068670 | A | A | A0101,A0301,B0702,B3501,C0401,C0702 | A0303 | 254 | 77 | svptptQak | svptptLak |
| TU0428 | MUC16 | 19 | 9084401 | T | T | A0101,A0301,B0702,B3501,C0401,C0702 | B0702 | 9 | 9 | rpVrfstm | rpV-Tfstm |
| TU0428 | MUC16 | 19 | 9084431 | T | C | A0101,A0301,B0702,B3501,C0401,C0702 | B3501 | 37 | 33 | rpltfstm | rpVrtfstm |
| TU0428 | MUC16 | 19 | 9090784 | A | C | A0101,A0301,B0702,B3501,C0401,C0702 | B0702 | 69 | 9 | rvksfssf | rvksfssl |
| TU0428 | OR7G1 | 19 | 9225973 | T | T | A0101,A0301,B0702,B3501,C0401,C0702 | C0702 | 243 | 379 | mfmstrmdVi | mfmstrmdAi |
| TU0428 | JUNB | 19 | 12903437 | A | C | A0101,A0301,B0702,B3501,C0401,C0702 | A0301 | 34 | 35 | rlaatNcrk | rlaatKcrk |
| TU0428 | IL27RA | 19 | 14153272 | T | T | A0101,A0301,B0702,B3501,C0401,C0702 | B3501 | 176 | 9232 | eaawtleL | eaawtheP |
| TU0428 | PKN1 | 19 | 14578707 | A | T | A0101,A0301,B0702,B3501,C0401,C0702 | B3501 | 170 | 1052 | Qpsgelfsi | Rpsgelfai |
| TU0428 | PKN1 | 19 | 14579707 | A | A | A0101,A0301,B0702,B3501,C0401,C0702 | B0702 | 379 | 213 | elfQpsgelf | elfOpsgelf |
| TU0428 | F2RL3 | 19 | 17001127 | G | G | A0101,A0301,B0702,B3501,C0401,C0702 | B0702 | 142 | 176 | ahlAavvl | ahlTavvl |
| TU0428 | USHBP1 | 19 | 17361108 | T | C | A0101,A0301,B0702,B3501,C0401,C0702 | A0301 | 88 | 4465 | Kataralgk | Eataralgk |
| TU0428 | KIRREL2 | 19 | 36349529 | G | C | A0101,A0301,B0702,B3501,C0401,C0702 | A0301 | 287 | 3504 | vlggpsvsl | vLggpsvsl |
| TU0428 | SUPT5H | 19 | 39949671 | C | A | A0101,A0301,B0702,B3501,C0401,C0702 | A0301 | 172 | 374 | eIgAyymlk | eIgEvymlk |
| TU0428 | PSG8 | 19 | 43258649 | T | T | A0101,A0301,B0702,B3501,C0401,C0702 | B3501 | 215 | 2494 | Qpaayswti | Ppaayswti |
| TU0428 | PSG8 | 19 | 43256650 | G | C | A0101,A0301,B0702,B3501,C0401,C0702 | B0702 | 239 | 1866 | Tpaayswti | Ppaayswti |
| TU0428 | PSG8 | 19 | 43258650 | G | G | A0101,A0301,B0702,B3501,C0401,C0702 | B3501 | 157 | 2404 | Tpaayswti | Ppaayswti |
| TU0428 | NKPD1 | 19 | 45056425 | T | C | A0101,A0301,B0702,B3501,C0401,C0702 | A0303 | 320 | 1480 | Mgfmcevkk | Lgfmcevkk |
| TU0428 | CCDC8 | 19 | 46915091 | C | T | A0101,A0301,B0702,B3501,C0401,C0702 | B0702 | 25 | 44 | apaGqgaea | apaOqgaea |
| TU0428 | SPIB | 19 | 50926126 | C | C | A0101,A0301,B0702,B3501,C0401,C0702 | A0301 | 27 | 32 | hlsqppLmk | hlsqppPmk |
| TU0428 | SPIB | 19 | 50926126 | C | C | A0101,A0301,B0702,B3501,C0401,C0702 | B0702 | 12 | 9414 | wphisqppL | wphlsqppP |
| TU0428 | SPIB | 19 | 50926126 | C | C | A0101,A0301,B0702,B3501,C0401,C0702 | B3501 | 20 | 1708 | wphisqppL | wphlsqppP |
| TU0428 | SIGLEC12 | 19 | 52000572 | A | A | A0101,A0301,B0702,B3501,C0401,C0702 | B0702 | 101 | 4973 | kmrpisgvM | kmrpisgvT |
| TU0428 | SIGLEC12 | 19 | 52000572 | A | A | A0101,A0301,B0702,B3501,C0401,C0702 | C0702 | 496 | 15186 | kmrpisgvM | kmrpisgvT |
| TU0428 | SIGLEC12 | 19 | 52004743 | C | C | A0101,A0301,B0702,B3501,C0401,C0702 | B0702 | 27 | 84 | ipvatmpV | ipvatmpA |
| TU0428 | SIGLEC12 | 19 | 52004743 | C | C | A0101,A0301,B0702,B3501,C0401,C0702 | B3501 | 135 | 137 | ipvatmpV | ipvatmpA |
| TU0428 | ZSCAN5A | 19 | 56733425 | A | U | A0101,A0301,B0702,B3501,C0401,C0702 | B3501 | 307 | 2853 | spVpasyvs | spGpasyvs |
| TU0428 | SNTG2 | 2 | 1204796 | T | C | A0101,A0301,B0702,B3501,C0401,C0702 | B0702 | 10 | 9 | apLspsspi | apSspsspi |
| TU0428 | NTSR2 | 2 | 11809819 | A | A | A0101,A0301,B0702,B3501,C0401,C0702 | B3501 | 9 | 25 | qplrarsPi | qptrarsLi |
| TU0428 | NTSR2 | 2 | 11809819 | A | A | A0101,A0301,B0702,B3501,C0401,C0702 | A0303 | 224 | 2397 | qplrarsPi | qplrarsLi |
| TU0428 | SMX17 | 2 | 27596143 | A | A | A0101,A0301,B0702,B3501,C0401,C0702 | B3501 | 31 | 632 | Ktfnsfirr | Etfnsfirr |
| TU0428 | PLB1 | 2 | 28814333 | G | A | A0101,A0301,B0702,B3501,C0401,C0702 | B0702 | 188 | 2955 | sVqgHgtwi | sMqgHgtwl |
| TU0428 | USP34 | 2 | 61528386 | A | C | A0101,A0301,B0702,B3501,C0401,C0702 | B0702 | 30 | 18 | fpgVfmgpv | fpgGfmgpv |
| TU0428 | USP34 | 2 | 61528586 | U | C | A0101,A0301,B0702,B3501,C0401,C0702 | B3501 | 392 | 219 | fpgVfmgpv | fpgGfmgpv |
| TU0428 | F8XO48 | 2 | 68692035 | A | C | A0101,A0301,B0702,B3501,C0401,C0702 | B0702 | 134 | 63 | kphcltvra | kphcMtvra |
| TU0428 | FABP1 | 2 | 88425806 | A | C | A0101,A0301,B0702,B3501,C0401,C0702 | A0301 | 60 | 154 | ivHngkhfk | ivOngkhfk |
| TU0428 | PTPN4 | 2 | 120643390 | A | G | A0101,A0301,B0702,B3501,C0401,C0702 | B3501 | 10 | 8 | spaeSefmy | spaeAefmy |
| TU0428 | CLASP1 | 2 | 122125239 | T | C | A0101,A0301,B0702,B3501,C0401,C0702 | B0702 | 17 | 50 | npypysHaa | npypysflaa |
| TU0428 | CLASP1 | 2 | 122125239 | G | C | A0101,A0301,B0702,B3501,C0401,C0702 | B3501 | 118 | 136 | npypysHai | npypysOai |

| | | | | | | | | | |
|---|---|---|---|---|---|---|---|---|---|
| TU0428 | FBLN2 | 3 | 13611896 | T | A | A0101,A0301,B0702,B3501,C0401,C0702 | B3501 | 42 | 8 | epagawlaQ | epagawlaL |
| TU0428 | FBLN2 | 3 | 13611896 | C | A | A0101,A0301,B0702,B3501,C0401,C0702 | B3501 | 168 | 66 | iaQglalal | iaLglalal |
| TU0428 | OSBPL10 | 3 | 31710315 | C | T | A0101,A0301,B0702,B3501,C0401,C0702 | C0702 | 470 | 623 | hyggkvhrl | hyggkvh-v |
| TU0428 | ITGA9 | 3 | 37819349 | C | A | A0101,A0301,B0702,B3501,C0401,C0702 | B3501 | 326 | 103 | ipaeHkem# | upqeQgmf |
| TU0428 | SCN10A | 3 | 38798272 | C | T | A0101,A0301,B0702,B3501,C0401,C0702 | A0101 | 430 | 379 | ilaVtmay | ilaVvtmay |
| TU0428 | SCN10A | 3 | 38798272 | C | T | A0101,A0301,B0702,B3501,C0401,C0702 | A0301 | 82 | 71 | ilaVtmay | ilaVvtmay |
| TU0428 | SCN10A | 3 | 38798272 | C | A | A0101,A0301,B0702,B3501,C0401,C0702 | B3501 | 358 | 275 | ilaVtmay | ilaVvtmay |
| TU0428 | MST1R | 3 | 49924840 | G | T | A0101,A0301,B0702,B3501,C0401,C0702 | C0702 | 415 | 22551 | ymnkgpsel | ymnkgpsS |
| TU0428 | IFRD2 | 3 | 50326091 | C | C | A0101,A0301,B0702,B3501,C0401,C0702 | A0303 | 352 | 222 | vlyVdswar | vlyMdswar |
| TU0428 | B4GALT4 | 3 | 1185457796 | T | A | A0101,A0301,B0702,B3501,C0401,C0702 | C0702 | 114 | 190 | yrpEeckal | yrpQeckal |
| TU0428 | HEG1 | 3 | 124729380 | G | T | A0101,A0301,B0702,B3501,C0401,C0702 | A0301 | 485 | 224486 | asvnscavk | asvnscavk |
| TU0428 | SNX4 | 3 | 125194163 | C | T | A0101,A0301,B0702,B3501,C0401,C0702 | A0301 | 93 | 47 | npdKrfcdl | npdKrfcdl |
| TU0428 | SI | 3 | 164709226 | T | A | A0101,A0301,B0702,B3501,C0401,C0702 | B3501 | 65 | 865 | Yasyttin# | Masyttin# |
| TU0428 | ZBBX | 3 | 167023493 | C | A | A0101,A0301,B0702,B3501,C0401,C0702 | A0301 | 50 | 89 | siKtsnlyk | siEtsnlyk |
| TU0428 | ZBBX | 3 | 167023493 | A | T | A0101,A0301,B0702,B3501,C0401,C0702 | B3501 | 464 | 123 | eslKsnly | eslElsrly |
| TU0428 | ATP13A4 | 3 | 192203394 | T | A | A0101,A0301,B0702,B3501,C0401,C0702 | A0301 | 64 | 18231 | qivsvkkuK | qiysvekvl |
| TU0428 | GPS | 3 | 194117882 | T | A | A0101,A0301,B0702,B3501,C0401,C0702 | A0301 | 57 | 256 | rVlpraif | rAlpraif |
| TU0428 | GP5 | 3 | 194117862 | A | A | A0101,A0301,B0702,B3501,C0401,C0702 | B0702 | 33 | 17 | rlrVlprai | rlrAlpral |
| TU0428 | GP5 | 3 | 194117882 | G | A | A0101,A0301,B0702,B3501,C0401,C0702 | C0702 | 123 | 118 | lrrnriVI | lrrnriAl |
| TU0428 | GP5 | 3 | 194117882 | G | C | A0101,A0301,B0702,B3501,C0401,C0702 | C0702 | 484 | 809 | lrVlpraif | lrAlpraif |
| TU0428 | HTT | 3 | 3215835 | T | U | A0101,A0301,B0702,B3501,C0401,C0702 | B3501 | 161 | 144 | vthacsHy | vthacsAy |
| TU0428 | HTT | 3 | 3215835 | G | C | A0101,A0301,B0702,B3501,C0401,C0702 | C0702 | 198 | 1804 | Hlycvhf#i | Llycvhf#i |
| TU0428 | HTT | 3 | 3234980 | C | A | A0101,A0301,B0702,B3501,C0401,C0702 | B0702 | 123 | 5509 | lpsrvgalt | lpxrvgaiH |
| TU0428 | HTT | 3 | 3234980 | C | G | A0101,A0301,B0702,B3501,C0401,C0702 | B0702 | 335 | 101 | rvgaHgvt | rvgaiHgvl |
| TU0428 | EVC2 | 4 | 5630442 | A | A | A0101,A0301,B0702,B3501,C0401,C0702 | A0301 | 396 | 69 | tTdffqask | lMdffqask |
| TU0428 | EVC2 | 4 | 5630442 | A | G | A0101,A0301,B0702,B3501,C0401,C0702 | B3501 | 271 | 824 | rwseifdif | rwselMdif |
| TU0428 | EVC | 4 | 5733236 | C | G | A0101,A0301,B0702,B3501,C0401,C0702 | C0702 | 347 | 9 | sAsslegsl | sPsslegsl |
| TU0428 | EVC | 4 | 57332736 | G | G | A0101,A0301,B0702,B3501,C0401,C0702 | B3501 | 169 | 189 | qpveasAss | qpveasPss |
| TU0428 | EVC | 4 | 57447035 | C | T | A0101,A0301,B0702,B3501,C0401,C0702 | A0101 | 468 | 320 | msgagdsDy | msgagdsEy |
| TU0428 | EVC | 4 | 57447035 | C | T | A0101,A0301,B0702,B3501,C0401,C0702 | B3501 | 40 | 10 | msgagdsDy | msgagdsEy |
| TU0428 | GPR78 | 4 | 85889954 | C | G | A0101,A0301,B0702,B3501,C0401,C0702 | A0303 | 55 | 9995 | rlkrtprR | rlkrtprF |
| TU0428 | GPR78 | 4 | 85889954 | C | G | A0101,A0301,B0702,B3501,C0401,C0702 | B0702 | 102 | 10135 | Rasthdssl | Pasthdssl |
| TU0428 | ARAP2 | 4 | 361620398 | A | A | A0101,A0301,B0702,B3501,C0401,C0702 | A0301 | 484 | 187 | slltQeelnk | slltKeelnk |
| TU0428 | GABRB1 | 4 | 47427856 | C | C | A0101,A0301,B0702,B3501,C0401,C0702 | C0702 | 237 | 154 | sreavgSal | sreavgRaf |
| TU0428 | KDR | 4 | 55955136 | C | T | A0101,A0301,B0702,B3501,C0401,C0702 | B0702 | 217 | 748 | tpemyKtm# | tpemyQtm# |
| TU0428 | UBA6 | 4 | 684354311 | T | A | A0101,A0301,B0702,B3501,C0401,C0702 | A0301 | 63 | 1086 | iLefkpsnk | iQefkpsnk |
| TU0428 | UGT2B10 | 4 | 69879751 | T | A | A0101,A0301,B0702,B3501,C0401,C0702 | B3501 | 273 | 89 | aMfwiefvm | aVivviefvm |
| TU0428 | UGT2A1 | 4 | 705051162 | G | A | A0101,A0301,B0702,B3501,C0401,C0702 | B3501 | 487 | 468 | tvlassVt | tvlassAtl |
| TU0428 | C5N3 | 4 | 71114356 | C | A | A0101,A0301,B0702,B3501,C0401,C0702 | B0702 | 204 | 20 | Lpnllqpsfi | Rpnllqpsfi |
| TU0428 | C5N3 | 4 | 71114356 | C | T | A0101,A0301,B0702,B3501,C0401,C0702 | C0702 | 276 | 17030 | shpptverit | shyptwvrR |
| TU0428 | GC | 4 | 72618334 | C | C | A0101,A0301,B0702,B3501,C0401,C0702 | B0702 | 102 | 112 | lpEatpieI | lpDatpiel |
| TU0428 | GC | 4 | 72618334 | C | A | A0101,A0301,B0702,B3501,C0401,C0702 | B3501 | 59 | 41 | lpEatpiel | lpDatpiel |
| TU0428 | PPEF2 | 4 | 76817445 | T | A | A0101,A0301,B0702,B3501,C0401,C0702 | B3501 | 224 | 42 | tstqphtsf | tstqphtAf |
| TU0428 | PPEF2 | 4 | 76817445 | C | A | A0101,A0301,B0702,B3501,C0401,C0702 | C0702 | 169 | 515 | Sfqnaeraf | Alqnaeraf |
| TU0428 | ART3 | 4 | 77035119 | C | A | A0101,A0301,B0702,B3501,C0401,C0702 | B3501 | 209 | 538 | epiqiTapg | eptqiPapg |
| TU0428 | CCDO2 | 4 | 841854440 | A | G | A0101,A0301,B0702,B3501,C0401,C0702 | C0702 | 334 | 327 | nrtlglAF | nrtlglVf |
| TU0428 | PPM1K | 4 | 891982298 | C | A | A0101,A0301,B0702,B3501,C0401,C0702 | A0303 | 380 | 20488 | ssharlsaY | ssharlsaD |
| TU0428 | PPM1K | 4 | 891982298 | C | A | A0101,A0301,B0702,B3501,C0401,C0702 | B3501 | 231 | 31635 | ssharlsaY | ssharlsaD |
| TU0428 | PPM1K | 4 | 891982298 | C | A | A0101,A0301,B0702,B3501,C0401,C0702 | C0702 | 295 | 836 | arlsaYatl | arlsaDatl |

| Sample | Gene | Chr | Pos | Ref | Alt | HLA alleles | HLA | Score1 | Score2 | Peptide1 | Peptide2 |
|---|---|---|---|---|---|---|---|---|---|---|---|
| TU0428 | OR2A5 | 7 | 143749257 | G | A | A0101,A0301,B0702,B3501,C0401,C0702 | C0702 | 291 | 254 | ffgaTlvmy | ffgaAlvmy |
| TU0428 | 2BED6CL | 7 | 150028087 | G | T | A0101,A0301,B0702,B3501,C0401,C0702 | B3501 | 257 | 156 | wasiivkNy | wasiivkAy |
| TU0428 | GBX1 | 7 | 150864368 | C | T | A0101,A0301,B0702,B3501,C0401,C0702 | A0301 | 416 | 17681 | rtrnifcoR | rtrnifcaG |
| TU0428 | MYOM2 | 8 | 2021539 | G | C | A0101,A0301,B0702,B3501,C0401,C0702 | C0702 | 261 | 15055 | lytIrivsL | lytlivsR |
| TU0428 | CSMD1 | 8 | 3000193 | G | A | A0101,A0301,B0702,B3501,C0401,C0702 | B0702 | 64 | 108 | lpigvgGIH | lpigvgGli |
| TU0428 | CSMD1 | 8 | 3253725 | G | C | A0101,A0301,B0702,B3501,C0401,C0702 | A0101 | 40 | 13358 | rssigfllY | rssigflIH |
| TU0428 | CSMD1 | 8 | 3253725 | G | T | A0101,A0301,B0702,B3501,C0401,C0702 | A0301 | 444 | 1453 | rssigfllY | rssigflIH |
| TU0428 | SLC7A2 | 8 | 17412140 | C | C | A0101,A0301,B0702,B3501,C0401,C0702 | A0301 | 42 | 630 | kSlaqinsk | tClaqinsk |
| TU0428 | ZNF703 | 8 | 37554940 | G | T | A0101,A0301,B0702,B3501,C0401,C0702 | A0301 | 228 | 17505 | srkdsgssL | srkdsgss5 |
| TU0428 | RP1 | 8 | 55539057 | G | A | A0101,A0301,B0702,B3501,C0401,C0702 | A0301 | 480 | 417 | tlsqk4H4x | tlkqkkRk |
| TU0428 | CYP7B1 | 8 | 65528568 | G | A | A0101,A0301,B0702,B3501,C0401,C0702 | A0101 | 286 | 530 | tswdMaehy | tswdTaehy |
| TU0428 | CYP7B1 | 8 | 65528568 | G | A | A0101,A0301,B0702,B3501,C0401,C0702 | B3501 | 191 | 201 | tswdMuety | tswdTaehy |
| TU0428 | CYP7B1 | 8 | 65528568 | C | T | A0101,A0301,B0702,B3501,C0401,C0702 | C0702 | 106 | 292 | wdRaeehypl | wdTaelypf |
| TU0428 | WISB | 8 | 95859315 | A | T | A0101,A0301,B0702,B3501,C0401,C0702 | A0301 | 140 | 324 | tvkdfsLak | tvkdfsHak |
| TU0428 | DGAT1 | 8 | 145541766 | G | A | A0101,A0301,B0702,B3501,C0401,C0702 | A0101 | 201 | 1025 | nlWyrdtwy | nITycdlwy |
| TU0428 | DGAT1 | 8 | 145541766 | G | A | A0101,A0301,B0702,B3501,C0401,C0702 | A0301 | 297 | 626 | vsypdnINy | vsypdnITv |
| TU0428 | DGAT1 | 8 | 145541766 | G | C | A0101,A0301,B0702,B3501,C0401,C0702 | B3501 | 348 | 24 | vsypdnINy | vsypdnITy |
| TU0428 | DGAT1 | 8 | 145541766 | C | T | A0101,A0301,B0702,B3501,C0401,C0702 | C0702 | 34 | 39 | WyrdiyyH | TyrdiyyH |
| TU0428 | CD72 | 9 | 35618053 | C | A | A0101,A0301,B0702,B3501,C0401,C0702 | B0702 | 478 | 407 | aviglpssl | avlgVpssl |
| TU0428 | CD72 | 9 | 35618053 | C | A | A0101,A0301,B0702,B3501,C0401,C0702 | B3501 | 39 | 35 | Lpsslassv | Vpsslassv |
| TU0428 | CD72 | 9 | 35618053 | C | A | A0101,A0301,B0702,B3501,C0401,C0702 | B3501 | 476 | 529 | vpavlgLps | vpavlgVps |
| TU0428 | CD72 | 9 | 35618053 | C | A | A0101,A0301,B0702,B3501,C0401,C0702 | B3501 | 103 | 876 | Lpsslassv | Vpsslassv |
| TU0428 | WNK2 | 9 | 96021312 | G | A | A0101,A0301,B0702,B3501,C0401,C0702 | B0702 | 37 | 106 | lptatvppM | lptatvppV |
| TU0428 | WNK2 | 9 | 96021312 | C | T | A0101,A0301,B0702,B3501,C0401,C0702 | B3501 | 4 | 73 | lptatvppM | lptatvppV |
| TU0428 | C9orf156 | 9 | 106723339 | C | T | A0101,A0301,B0702,B3501,C0401,C0702 | B0702 | 464 | 2792 | radgaprsM | radgaprsV |
| TU0428 | C9orf156 | 9 | 106723338 | C | C | A0101,A0301,B0702,B3501,C0401,C0702 | B0702 | 15 | 21 | aprsMvpaw | aprsVvpaw |
| TU0428 | OR13D1 | 9 | 107458892 | G | T | A0101,A0301,B0702,B3501,C0401,C0702 | C0702 | 289 | 352 | fffilcVim | fffilcLim |
| TU0428 | MXRAS | X | 32405568 | G | G | A0101,A0301,B0702,B3501,C0401,C0702 | A0301 | 99 | 113 | SIiikkgmk | Tliikkgmk |
| TU0428 | CXorf22 | X | 36007614 | T | G | A0101,A0301,B0702,B3501,C0401,C0702 | B3501 | 153 | 134 | elvgydvry | ef vgyIIvy |
| TU0428 | CCNB3 | X | 50094370 | C | A | A0101,A0301,B0702,B3501,C0401,C0702 | C0702 | 70 | 91 | yykysKQyf | vykysNPvf |
| TU0428 | CCNB3 | X | 50094370 | C | A | A0101,A0301,B0702,B3501,C0401,C0702 | C0702 | 178 | 212 | vykyshQxff | ykyshPvff |
| TU0428 | DGKK | X | 50113438 | G | T | A0101,A0301,B0702,B3501,C0401,C0702 | C0702 | 137 | 3808 | sYqstlgnl | sVqsHgnl |
| TU0428 | PAK3 | X | 110463619 | A | G | A0101,A0301,B0702,B3501,C0401,C0702 | B0702 | 9 | 10 | kpbGltpi | kpbsStpi |
| TU0428 | PAK3 | X | 110463619 | C | G | A0101,A0301,B0702,B3501,C0401,C0702 | B3501 | 312 | 417 | kpbsGItpi | kpbsStpi |
| TU0428 | MAGEC1 | X | 140994591 | C | T | A0101,A0301,B0702,B3501,C0401,C0702 | B0702 | 120 | 42 | spertQstf | spertHstf |
| TU0428 | MAGEC1 | X | 140994591 | C | T | A0101,A0301,B0702,B3501,C0401,C0702 | B3501 | 439 | 289 | spertQstf | spertHstf |
| TU0428 | MAGEA3 | X | 151935932 | A | C | A0101,A0301,B0702,B3501,C0401,C0702 | B0702 | 76 | 16 | lpttmrypl | lpttmrypi |
| TU0428 | MAGEA3 | X | 151935932 | A | C | A0101,A0301,B0702,B3501,C0401,C0702 | B3501 | 70 | 14 | lpturnrvpl | lpttmryph |
| TU0428 | MAGEA5 | X | 997847108 | A | G | A0101,A0301,B0702,B3501,C0401,C0702 | A0301 | 551 | 443 | ytslvesck | yzsMvsck |
| VA1330 | UPPR4 | 1 | 156830779 | G | A | A0301,A2601,B3502,B4403,C0401 | B4403 | 29 | 25055 | aEpgsiIxw | aEpgsilxxw |
| VA1330 | NTRK1 | 1 | 425129367 | C | A | A0301,A2601,B3502,B4403,C0401 | A0303 | 131 | 372 | Rlkfqpvek | Slkfqpvek |
| VA1330 | GXYLT1 | 12 | 1794267988 | A | T | A0301,A2601,B3502,B4403,C0401 | A0301 | 91 | 168 | sbskGask | ssikEask |
| VA1330 | TTN | 2 | 37007486 | C | A | A0301,A2601,B3502,B4403,C0401 | A0301 | 153 | 208 | kqrvMvmhy | kqrvkmhy |
| VA1330 | NIPBL | 5 | 37007486 | A | C | A0301,A2601,B3502,B4403,C0401 | A0303 | 42 | 89 | rvMvmlynk | rvMvmlynk |
| VA1330 | NIPBL | 5 | 267655361 | A | T | A0301,A2601,B3502,B4403,C0401 | B4403 | 39 | 81 | eeevwqHkf | eevwqClkf |
| VA1330 | SKAP2 | 7 | 330056230 | C | T | A0301,A2601,B3502,B4403,C0401 | A0301 | 149 | 293 | qtirih5lk | qtirihGlk |
| VA1330 | SMU1 | 9 | 330056230 | C | T | A0301,A2601,B3502,B4403,C0401 | A0303 | 53 | 63 | rhSIksgk | rihGlksgk |
| VA1330 | SMU1 | 9 | 330562307 | A | T | A0301,A2601,B3502,B4403,C0401 | A0301 | 79 | 87 | SIksgxtk | GIksgxtk |
| VA1330 | SVEP1 | 9 | 1132715377 | G | A | A0301,A2601,B3502,B4403,C0401 | A0301 | 348 | 326 | elvArRpalk | elvHCpalk |

| | | | | | | | | | |
|---|---|---|---|---|---|---|---|---|---|
| ZA6965 | C5MD3 | 8 | 1136977930 | C | A | A0201,A3201,A0289,B4001102,B4501101,C0602,C03:A3201 | 71 | 1850 | ctsnftaapi | ctsnftapM |
| ZA6965 | ZNF517 | 8 | 146033463 | C | T | A0201,A3201,A0289,B4001102,B4501101,C0602,C03:A0201 | 169 | 150 | sillihiC1 | sillihiR1 |
| ZA6965 | ZNF517 | 8 | 146033463 | C | T | A0201,A3201,A0289,B4001102,B4501101,C0602,C03:A0201 | 380 | 2597 | lihiCiht | lihiRiht |
| ZA6965 | DPH7 | 9 | 140473202 | C | A | A0201,A3201,A0289,B4001102,B4501101,C0602,C03:A0201 | 147 | 142 | alqtLdteI | alqtVdteI |
| ZA6965 | FAM155B | x | 687499680 | T | A | A0201,A3201,A0289,B4001102,B4501101,C0602,C03:A0201 | 172 | 419 | rfSvlvImI | rfCvlvImI |
| ZA6965 | FAM155B | x | 687499680 | T | A | A0201,A3201,A0289,B4001102,B4501101,C0602,C03:A3201 | 314 | 516 | rfSvlvImI | rfCvlvImI |
| ZA6965 | FAM155B | x | 687499680 | T | A | A0201,A3201,A0289,B4001102,B4501101,C0602,C03:C0602 | 146 | 751 | srirfSvlv | srirfCvlv |
| ZA6965 | FAM155B | x | 687499680 | T | A | A0201,A3201,A0289,B4001102,B4501101,C0602,C03:C0602 | 279 | 2682 | lrfSvlvlm | lrfCvlvlm |
| ZA6965 | ZFP92 | x | 152686788 | G | A | A0201,A3201,A0289,B4001102,B4501101,C0602,C03:A3201 | 72 | 70 | rshsgeQpf | rshsgeRpf |

Figure 21 (Cont.)

DETERMINANTS OF CANCER RESPONSE TO IMMUNOTHERAPY BY PD-1 BLOCKADE

SEQUENCE LISTING

The instant application contains a Sequence Listing which has been submitted electronically in ASCII format and is hereby incorporated by reference in its entirety. Said ASCII copy, created on Dec. 30, 2015, is named 2003080-0984_SL.txt and is 1,630,136 bytes in size.

BACKGROUND

Cancer immunotherapy involves the attack of cancer cells by a patient's immune system. Regulation and activation of T lymphocytes depends on signaling by the T cell receptor and also cosignaling receptors that deliver positive or negative signals for activation. Immune responses by T cells are controlled by a balance of costimulatory and inhibitory signals, called immune checkpoints.

Immunotherapy with immune checkpoint inhibitors is revolutionizing cancer therapy. For example, in certain melanoma patients, anti-CTLA4 and anti-PD1 antibodies have offered a remarkable opportunity for long-term disease control in the metastatic setting.

SUMMARY

The present invention encompasses the discovery that the likelihood of a favorable response to cancer immunotherapy can be predicted. The present invention particularly comprises the discovery that, for certain cancers, mutation burden can correlate with responsiveness to particular therapy. Still further, the present invention provides the finding that certain cancer cells may harbor somatic mutations that result in neoepitopes that are recognizable by a patient's immune system as non-self, and that presence and/or identity of such neoepitopes may correlate with responsiveness to particular therapy. The identification of multiple mutations in a cancer sample as described herein is useful for determining which cancer patients are likely to respond favorably to immunotherapy, in particular, treatment with an immune checkpoint modulator.

The present disclosure defines certain characteristics of particular tumor cells that can be detected to predict responsiveness to immunotherapy, and particularly to therapy with immune checkpoint modulators. Among other things, the present disclosure provides tools and technologies that can be practically applied to define, characterize, and/or detect "signatures" of tumor responsiveness.

For example, the present disclosure provides tools and technologies that provide effective prediction or assessment of the likelihood that a particular tumor will respond to a particular therapy. Among other things, the present disclosure provides tools for defining or detecting particular features of cancer cells that may act as a proxy for underlying aspects of biology that support the natural correlation. The present disclosure demonstrates, for example, that particular, limited, signatures can be defined that are useful to define or detect such features, and provides detection formats that utilize these signatures. Moreover, the present disclosure demonstrates that provided formats are more effective and/or informative, in at least some contexts, than are other methodologies for applying the biological correlation.

In some embodiments, the invention provides methods for identifying a subject as likely to respond to treatment with an immune checkpoint modulator.

In some embodiments, the methods comprise steps of detecting a marker of high mutations in a cancer sample from a subject; and identifying the subject as a candidate for treatment with an immune checkpoint modulator. In some embodiments, the step of detecting comprises sequencing one or more exomes from the cancer sample.

In some embodiments, the number of mutations identifies the subject as a candidate for treatment with an immune checkpoint modulator. In some embodiments, a high number of mutations identifies the subject as a candidate for treatment with an immune checkpoint modulator. In some embodiments, a high number of nonsynonymous mutations identifies the subject as a candidate for treatment with an immune checkpoint modulator.

In some embodiments, the ratio of transition mutations to transversion mutations identifies the subject as a candidate for treatment with an immune checkpoint modulator. In some embodiments, the ratio comprises the molecular smoking signature.

In some embodiments, the somatic mutation comprises a neoepitope recognized by a T cell. In some embodiments, the number of neoepitopes identifies the subject as a candidate for treatment with an immune checkpoint modulator. In some embodiments, neoepitopes identify the subject as a candidate for treatment with an immune checkpoint modulator.

In some embodiments, the neoepitopes are associated with high mutation rate. In some embodiments, high mutations are present in genes encoding proteins involved in DNA repair. In some embodiments, high mutations are present in genes encoding proteins involved in cell signal transduction.

In some embodiments, the neoepitope has greater binding affinity to a major histocompatibility complex (MHC) molecule compared to a corresponding epitope that does not have a mutation.

In some embodiments, the somatic mutation comprises a neoepitope comprising a nonamer that is not expressed in the same cell type that does not have a somatic mutation.

In some embodiments, the neoepitope shares a consensus sequence with an infectious agent.

In some embodiments, the cancer is or comprises a cancer selected from the group comprising: carcinoma, sarcoma, myeloma, leukemia, or lymphoma. In some embodiments, the cancer is selected from a group comprising: lung carcinoma, melanoma, renal carcinoma, bladder carcinoma, small cell carcinoma, and head and neck cancer.

In some embodiments, the immune checkpoint modulator interacts with cytotoxic T-lymphocyte antigen 4 (CTLA4), programmed death 1 (PD-1) or its ligands, lymphocyte activation gene-3 (LAG3), B7 homolog 3 (B7-H3), B7 homolog 4 (B7-H4), indoleamine (2,3)-dioxygenase (IDO), adenosine A2a receptor, neuritin, B- and T-lymphocyte attenuator (BTLA), killer immunoglobulin-like receptors (KIR), T cell immunoglobulin and mucin domain-containing protein 3 (TIM-3), inducible T cell costimulator (ICOS), CD27, CD28, CD40, CD137, or combinations thereof.

In some embodiments, the immune checkpoint modulator is an antibody agent. In some embodiments, the antibody agent is or comprises a monoclonal antibody or antigen binding fragment thereof. In some embodiments, the antibody is pembrolizumab.

In some embodiments, the subject has not previously been treated with a cancer therapeutic. In some embodiments, the subject has not previously been treated with a cancer immunotherapeutic.

In some embodiments, the method of identifying a subject for treatment with an immune checkpoint modulator further comprises a step of administering pembrolizumab to the subject.

In some embodiments, the invention provides methods for detecting a low number of mutations in a cancer sample from a subject; and identifying the subject as a poor candidate for treatment with an immune checkpoint modulator.

In some embodiments, the invention provides methods for determining a subject has a cancer comprising a marker of high mutations, wherein the mutations comprises a neoepitope comprising a nonamer, and selecting for the subject a cancer treatment comprising an immune checkpoint modulator. In some embodiments, the cancer comprises lung carcinoma.

In some embodiments, the invention provides methods for improving efficacy of cancer therapy with an immune checkpoint modulator, the method comprising a step of: selecting for receipt of the therapy a subject identified as having a cancer with markers of high mutation comprising a neoepitope recognized by a T cell.

In some embodiments, the invention provides methods for treating cancer by administering immune checkpoint modulator therapy, the improvement that comprises: administering the therapy to a subject identified as having a cancer with one or more markers of high mutation comprising a neoepitope recognized by a T cell.

In some embodiments, the invention provides methods for treating a cancer selected from the group consisting of carcinoma, sarcoma, myeloma, leukemia, or lymphoma, the method comprising a step of: administering immune checkpoint modulator therapy to a subject identified as having a cancer with a marker of high mutations comprising a neoepitope recognized by a T cell. In some embodiments, the cancer is or comprises lung carcinoma.

In some embodiments, the invention provides methods for defining a mutation signature that correlates with responsiveness to therapy with an immune checkpoint modulator, the method comprising: determining one or more mutation characteristics in a plurality of samples of tumors sharing a response characteristic to immune checkpoint modulator therapy; comparing the determined one or more mutation characteristics with those in a plurality of samples of tumors that do not share the response characteristic; and identifying a set of mutation characteristics whose presence correlates with the response characteristic.

In some embodiments, the one or more mutation characteristics include a mutation characteristic selected from the group consisting of mutation burden, nonsynonymous mutation burden, neoantigen burden, transversion burden, transition burden, relative transversion vs transition burden, mutation burden in genes associated with DNA repair, presence of mutation in one or more particular genes associated with DNA repair, identity of mutation in one or more particular genes associated with DNA repair, and combinations thereof. In some embodiments, the determined burden is or comprises rate or number. In some embodiments, the genes associated with DNA repair are or include a genes selected from the group consisting of POLD1, PRKDC, DNA-PK, RAD17, POLE, and MSH2. In some embodiments, genes not associated with DNA repair that harbor mutation characteristics include genes selected from the group consisting of POLR2A, KEAP1, PAPPA2, PXDNL, RYR1, SCN8A, SLIT3 and KRAS.

In some embodiments, the response characteristic is or comprises a characteristic selected from the group consisting of partial or stable response lasting longer than 6 months ("durable clinical benefit"; "DCB"), a reduction in tumor size for more than 4 weeks ("objective response rate"; "ORR"); no disease progression for more than 9 weeks ("progression-free survival"; "PFS"), and combinations thereof.

In some embodiments, the invention provides methods for characterizing a tumor sample by determining presence of a set of mutation characteristics that correlates with a response characteristic to immune checkpoint modulator therapy.

In some embodiments, the step of determining comprises detecting at least one of the mutation characteristics by nucleic acid sequencing. In some embodiments, the nucleic acid sequencing is or comprises whole exome sequencing.

BRIEF DESCRIPTION OF THE DRAWING

The following figures are presented for the purpose of illustration only, and are not intended to be limiting.

In FIG. 1B, higher nonsynonymous mutation burden (above median of discovery cohort (n=8)) correlated with improved PFS compared to tumors with lower nonsynonymous mutation burden (n=8) (HR 0.19, 95% CI 0.05-0.70, p=0.01). IN FIG. 1C, in validation cohort, median nonsynonymous mutation burden is also greater in tumors from patients with DCB (n=7) compared to those with NDB (n=7) (median 244 vs 125, p=0.04). In FIG. 1D, higher nonsynonymous mutation burden (above median of validation cohort, n=9) again correlated with improved PFS compared to those with lower nonsynonymous mutation burden (n=9) (HR 0.15, 95% CI 0.04-0.59, p=0.006). In FIG. 1E the ROC curve for nonsynonymous mutation burden prediction of DCB in discovery cohort. AUC is 0.86 (95% CI 0.66-1.05, p=0.02). Cut-off of ≥178 nonsynonymous mutations is designated by triangle. According to FIG. 1F nonsynonymous mutation burden in those with DCB (n=14) compared to those with NCB (n=17) for the entire set of sequenced tumors (median 299 vs 127, p=0.0008). According to FIG. 1G PFS is improved in those with higher nonsynonymous mutation burden (n=17) compared to those with lower nonsynonymous mutation burden (n=17) in the entire set of sequenced tumors (HR 0.19, 95% CI 0.08-0.47, p=0.0004). In FIGS. 1A, 1C, and 1F, median and interquartile ranges of total nonsynonymous mutations are shown, with individual values for each tumor shown with dots.

FIG. 2A shows the molecular smoking signature significantly associates with improved PFS. Tumors characterized as TH as by molecular smoking signature classifier (n=16) have improved progression-free survival compared to those with TL signature (n=18) (HR 0.15, 95% 0.06-0.39, p=0.0001). FIG. 2B shows there is no significant difference in PFS between ever (n=28) and never smokers (n=6) (HR 0.52, 95% CI 0.15-1.8, p=0.29).

Figure 4A:
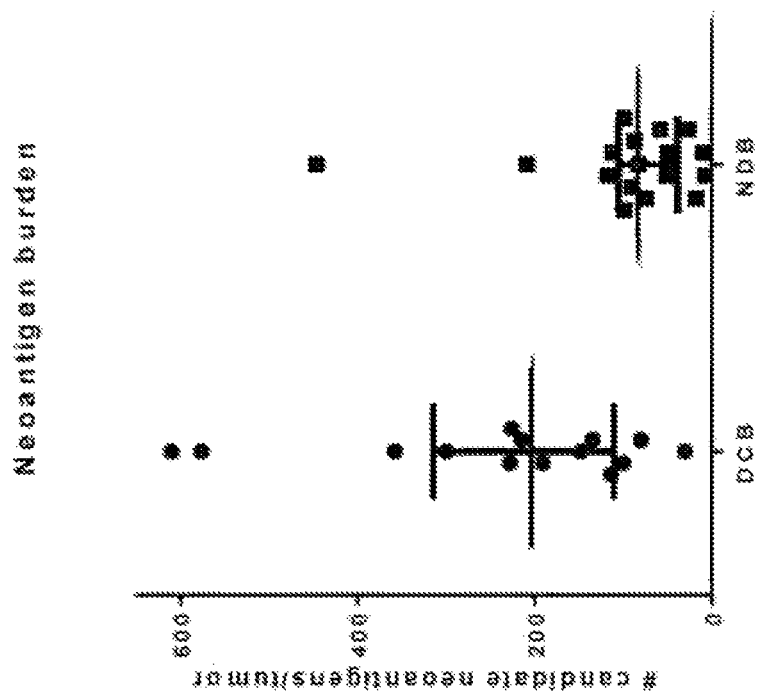
Figure 4B:
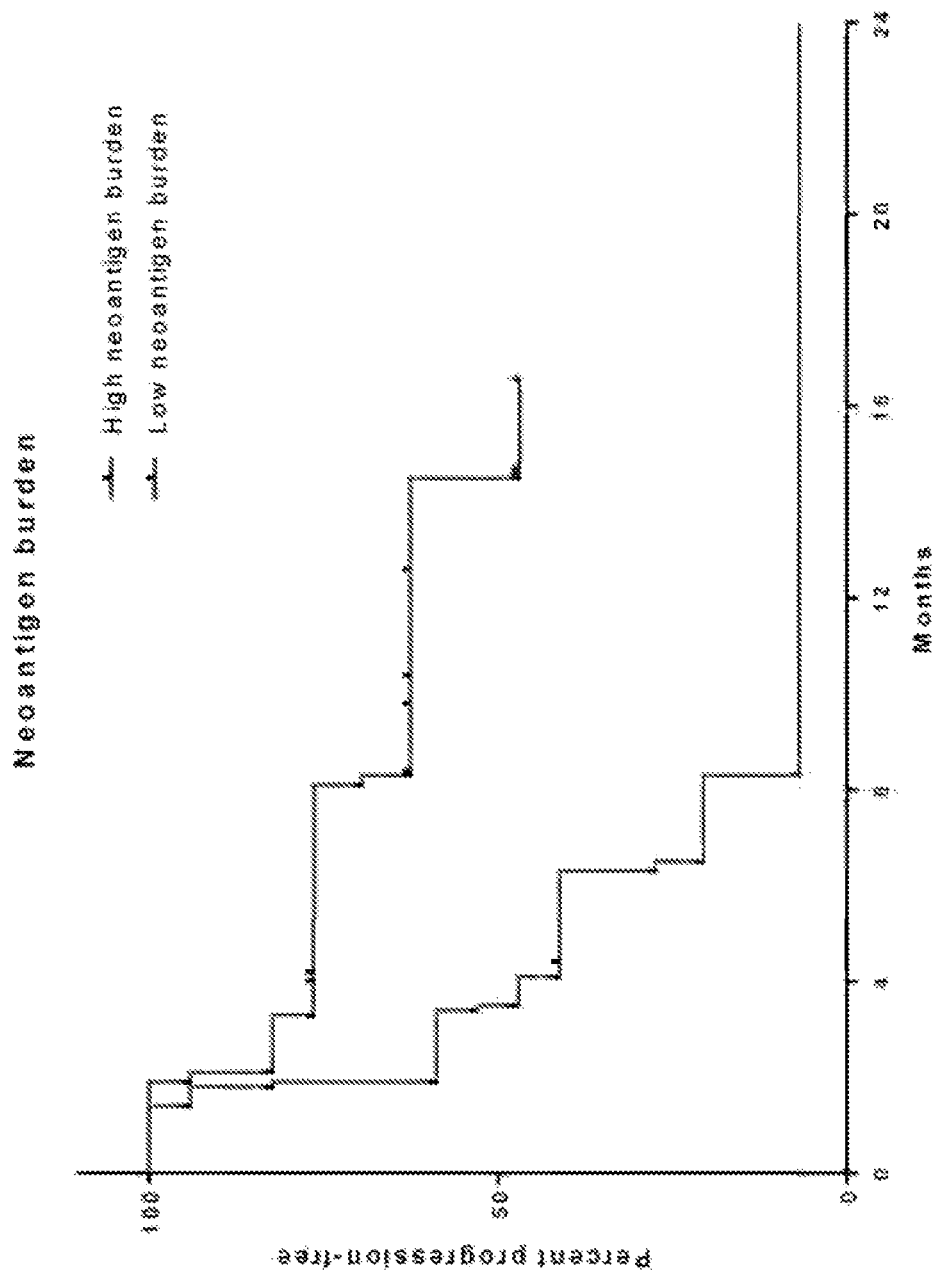
Figure 4C:
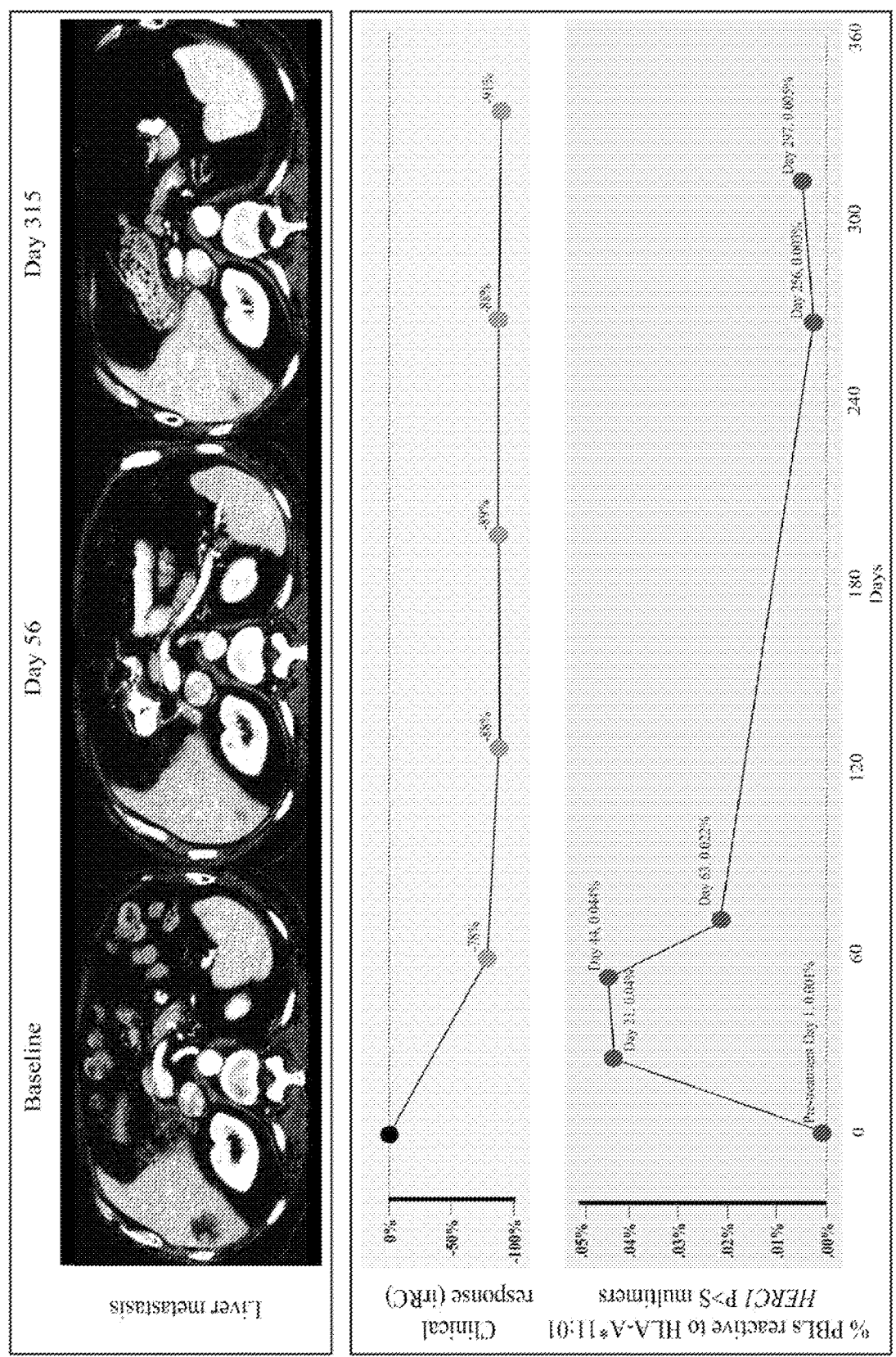
Figure 4E:
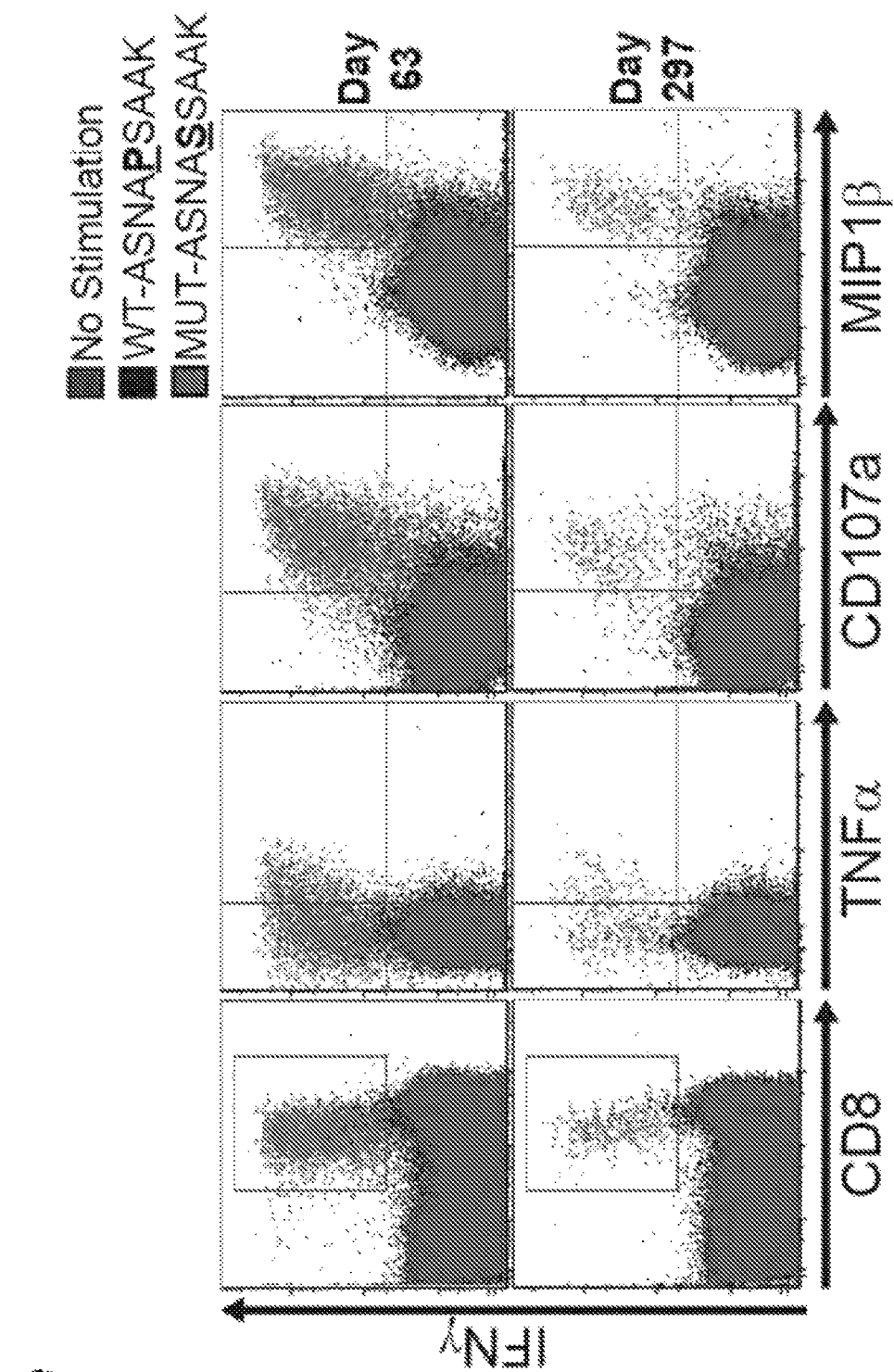

FIGS. 4A-4E show candidate neoantigens, neoantigen-specific T-cell response, and response to pembrolizumab. FIG. 4A illustrates that across the overall set of sequenced tumors, neoantigen burden is greater tumors from patients with DCB (n=14) compared to NDB (n=17) (median 203 vs 83, p=0.001). FIG. 4B shows higher neoantigen burden (above median of overall set, n=17)) correlates with improved PFS compared to tumors with lower neoantigen burden (n=17) (HR 0.23, 95% CI 0.09-0.58, p=0.002). In FIG. 4C the top panel shows representative computed tomography (CT) images of a liver metastasis prior to and at days after initiating treatment, as indicated. Middle panel of FIG. 4C shows decline of tumor burden. While the bottom panel of FIG. 4C shows the anti-HERC1 P>S CD8+ T-cell response measured in peripheral blood. FIG. 4D shows a CD8+ T-cell population in serially-collected autologous PBLs recognizing the HERC1 P>S neoantigen (ASNASSAAK (SEQ ID NO: 344)) was detected after beginning pembrolizumab, represented by the events in the double positive position indicated in black. Percentages indicate the number of CD8+ MHC multimer+ cells out of total CD8 cells. FIG. 4E shows autologous T-cell response to WT HERC1 peptide (SEQ ID NO: 5925) (black) vs. mutant HERC1 P>S neoantigen (SEQ ID NO: 344) (red) vs. no stimulation (blue), as detected by intracellular cytokine staining. T-cell co-stains for IFNγ and CD8, TNFα, CD107a, and MIPβ, respectively, are displayed for the Day 63 and Day 297 time points.

FIG. 5 coverage and depth of target exome sequence. Coverage and depth of sequenced exomes is similar in discovery compared to validation cohorts and is similar in those with durable clinical benefit (DCB) compared to those with no durable benefit (NDB).

FIG. 6 shows an exome analysis pipeline.

Figure 7B:
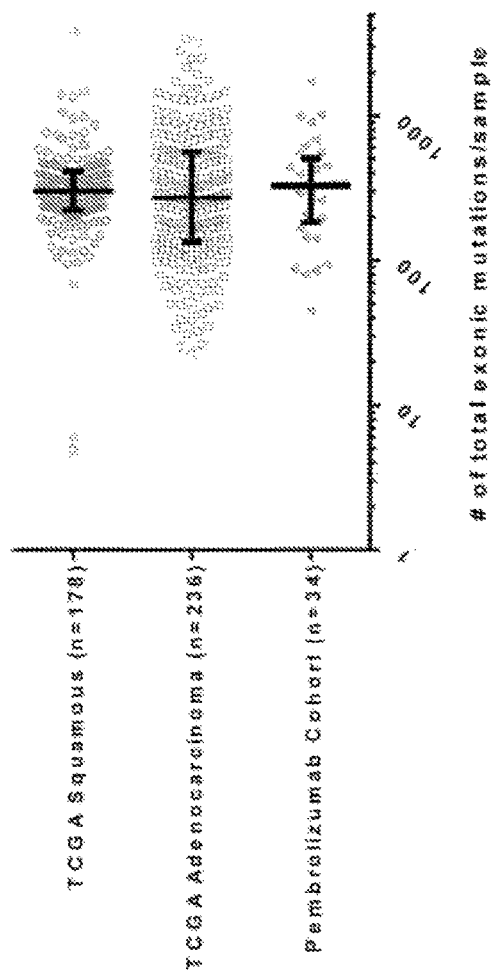

FIGS. 7A-7B show median and interquartile range of mutations in the current study and in published series of NSCLC (13, 14). FIG. 7A shows somatic nonsynonymous mutation burden. FIG. 7B shows total exonic mutations.

Figure 8:
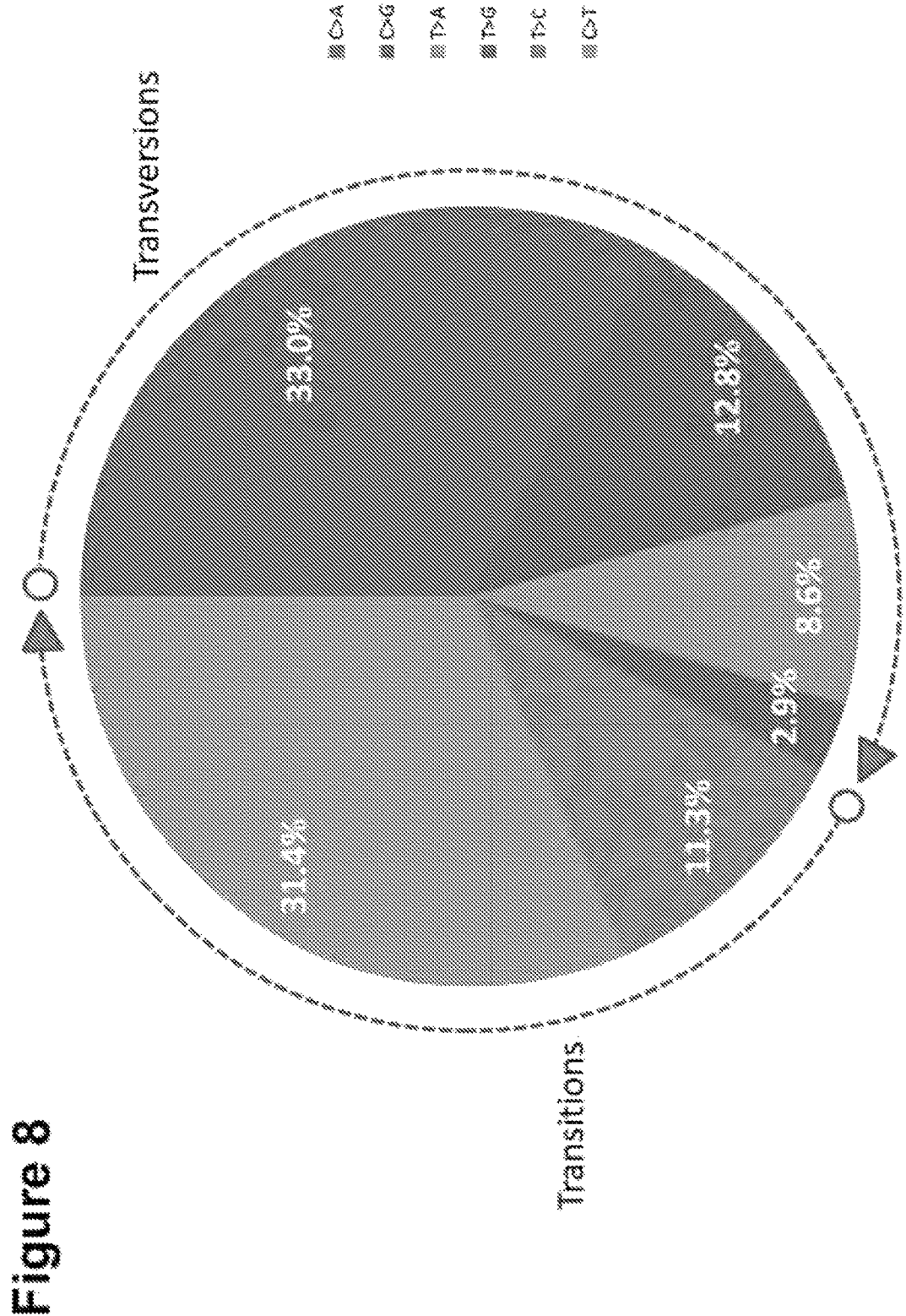

FIG. 8 shows a pattern of nucleotide changes in tumors sequenced. The spectrum and frequency of nucleotide changes in the pembrolizumab-treated NSCLCs is typical of non-small cell lung cancers.

Figure 9:
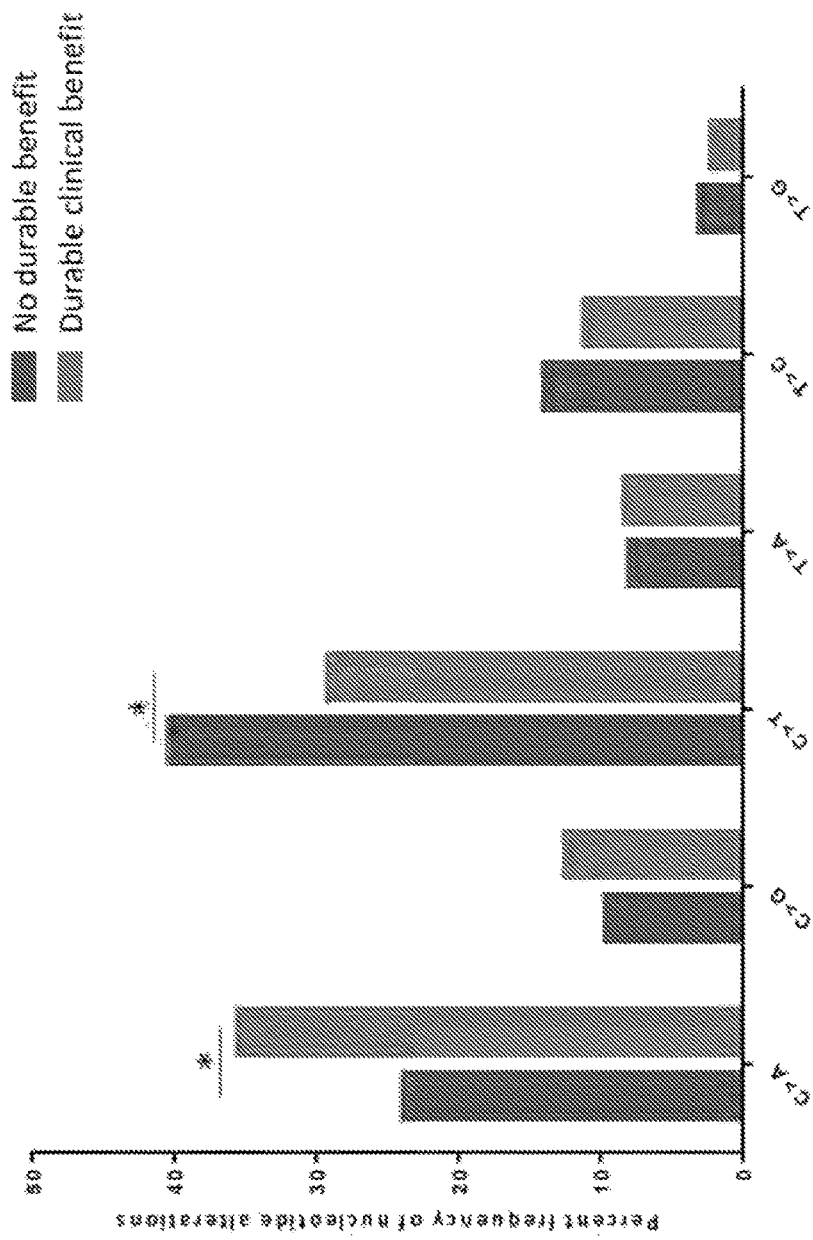

FIG. 9 shows a distribution of nucleotide alterations in nonsynonymous mutations. Across the overall set of sequenced NSCLCs treated with pembrolizumab, C>A transversions are more frequent in those with DCB, while C>T transitions are more frequent in those with NDB (*denotes p=0.01).

Figure 10:
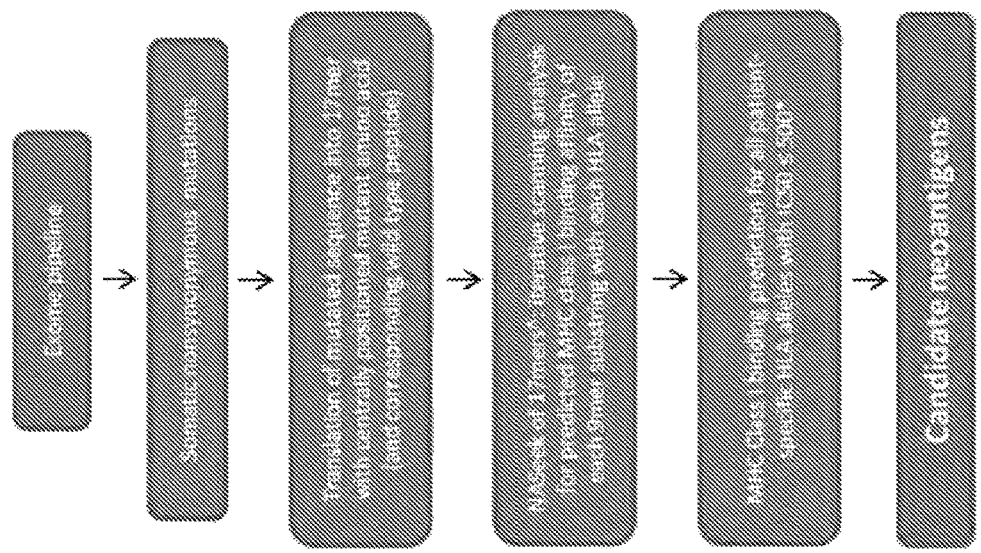

FIG. 10 shows a neoantigen analysis pipeline. ^All steps are executed for predicted wild type and mutant. *MHC Class I prediction by NetMHCv3.4.

Figure 11:
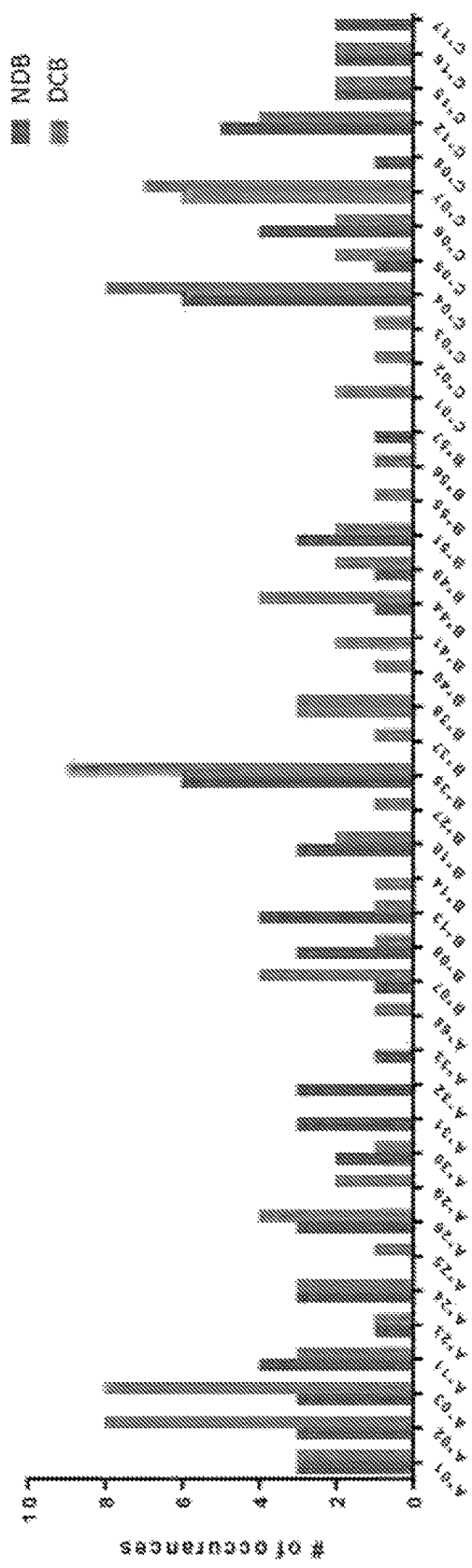

FIG. 11 shows HLA type and benefit to pembrolizumab. There was no evident association between the presence of any specific HLA allele and benefit from pembrolizumab.

Figure 12:
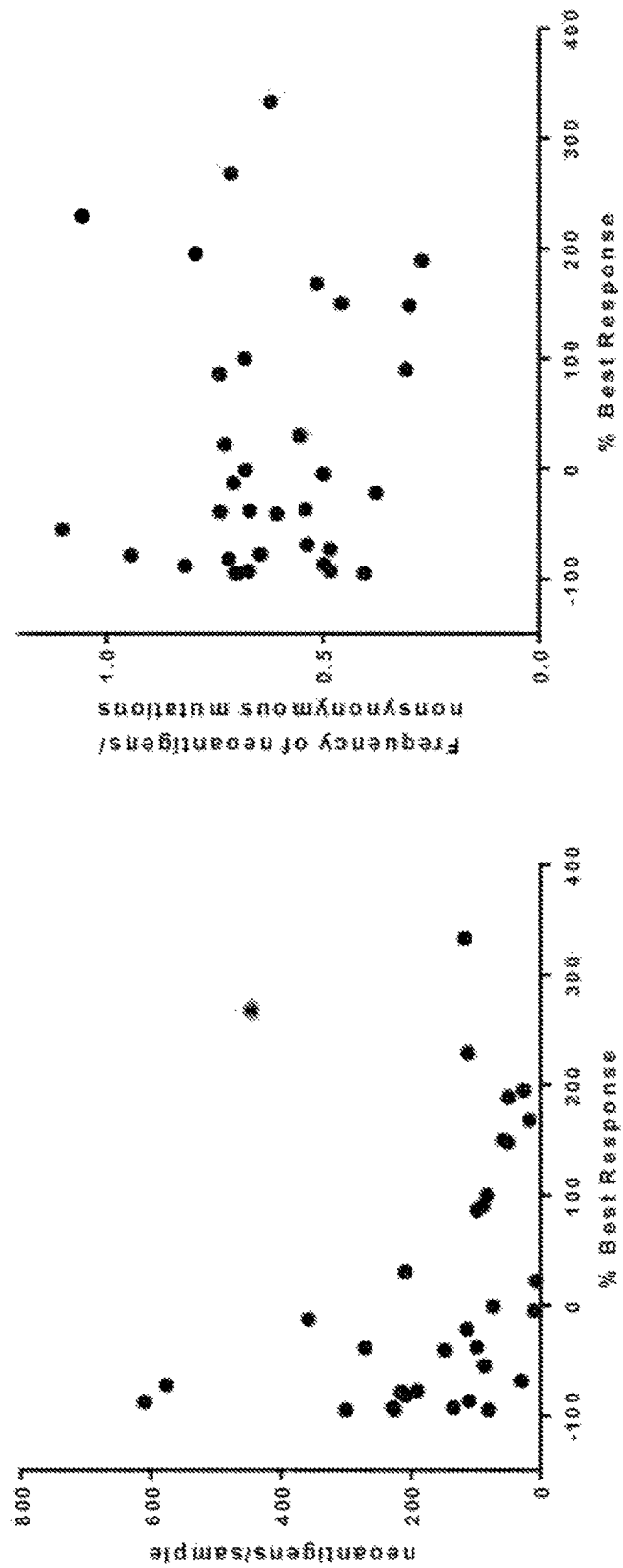

FIG. 12 depicts neoantigens and best objective response. The absolute quantity of predicted neoantigens correlates with best overall response (Spearman ρ–0.43, 95% CI–0.68--0.10, p=0.01), but the frequency of neoantigens/nonsynonymous mutation does not (Spearman ρ–0.04, 95% CI –0.39-0.30, p=0.78).

FIGS. 13A-13D demonstrate that following expansion, stimulation of peripheral blood mononuclear cells with wild type (SEQ ID NO: 5925) or mutant (SEQ ID NO: 344) peptide versus no stimulation control shows a polyfunctional CD8+ T cell response to the mutant peptide only. FIG. 13A shows neoantigen-induced IFNγ production by CD3+CD8+ T-cells at day 63 and day 297 after initiation of therapy. FIG. 13B shows co-staining of CD107a in CD3+CD8+IFNγ+ cells when stimulated with mutant peptide versus no stimulation or wild type. FIG. 13C shows co-staining of MIP-1β in CD3+CD8+IFNγ+ cells when stimulated with mutant peptide versus no stimulation or wild type. FIG. 13D shows co-staining of TNF-α in CD3+CD8+IFNγ+ cells when stimulated with mutant peptide versus no stimulation or wild type.

FIGS. 14A-14Q, show the DNA quality metrics.

FIG. 15 depicts a table summarizing clinical and genomic charateristics.

FIG. 16 depicts a table demonstrating nonsynonymous, total exonic mutation burden, and association with clinical efficacy to pembrolizumab. Analyzed independently, non-synonymous mutation burden significantly correlates with improved confirmed ORR, DCB, and PFS (with the exception of ORR for the validation cohort, p=0.33). Clinical efficacy strongly correlates with nonsynonymous mutation burden in the overall set of sequenced NSCLCs. High total exonic mutation burden less strongly correlates with improved clinical efficacy. ∧Denotes that three patients are currently undergoing therapy and have not yet reached 6 months of follow-up; as such, these patients are not included in the DCB/NDB calculations and are removed from the numerator and denominator.

FIG. 17 depicts a table of detailed clinical and genomic characteristics of individual patients.

FIG. 18 depicts a table of quality metrics for all samples.

FIG. 19A-19B depict the correlation of molecular smoking signature, nonsynonymous mutation burden, and neoantigen burden. FIG. 19A shows a hive plot that displays the relationship between molecular smoking signature, mutation and neoantigen burden for each tumor. Red lines depict transversion low tumors; blue lines depict transversion high tumors. Transversion low tumors have significantly lower mutation and neoantigen burden compared to transversion high tumors (Mann Whitney p<0.0001 for both). Nonsynonymous mutation burden correlates with neoantigen burden (Spearman ρ0.91, 95% CI 0.83-0.96, p<0.0001). In FIG. 19B, this hive plot displays the relationship between pack-years of tobacco consumption, mutation and neoantigen burden for each tumor. Red lines depict those who are light/never smokers (≤median pack-years of the cohort, 25); blue lines heavy smokers (>25 pack-years). Modest correlation is seen between pack-years and non-synonymous mutation burden (Spearman ρ0.31, 95% CI –0.05-0.59, p=0.08) as well as between pack-years and neoantigen burden (Spearman ρ0.35, 95% CI 0-0.62, p=0.04).

Figure 20:
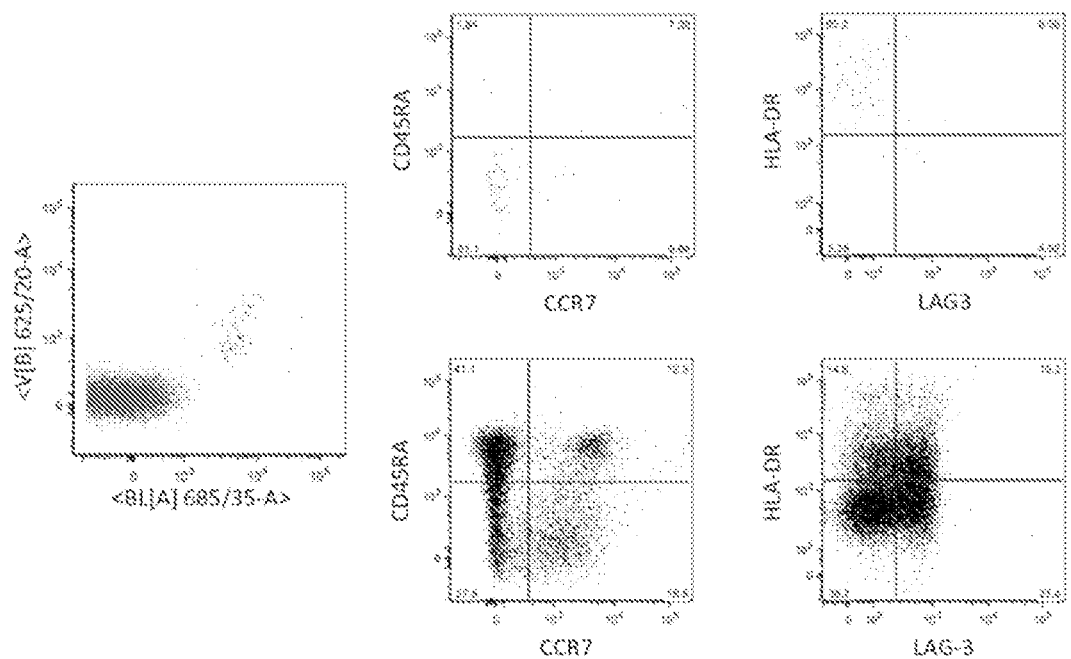

FIG. 20 depicts the immunophenotype of neoantigen-specific T-cells. In the left panel, peripheral blood lymphocytes (PBLs) from day 44 were used to identify HERC1 P3278S neoantigen (ASNASSAAK (SEQ ID NO: 344)) reactive T-cells using two-color MHC multimer staining, as described. Neoantigen-specific T-cells are represented by the events in the double positive position. Flow cytometry dot plots of staining of HERC1 P3278S neoantigen-specific T-cells (Top panels) and bulk CD8+ T-cells (Bottom panels) show expression of indicated phenotypic markers.

Figure 21:
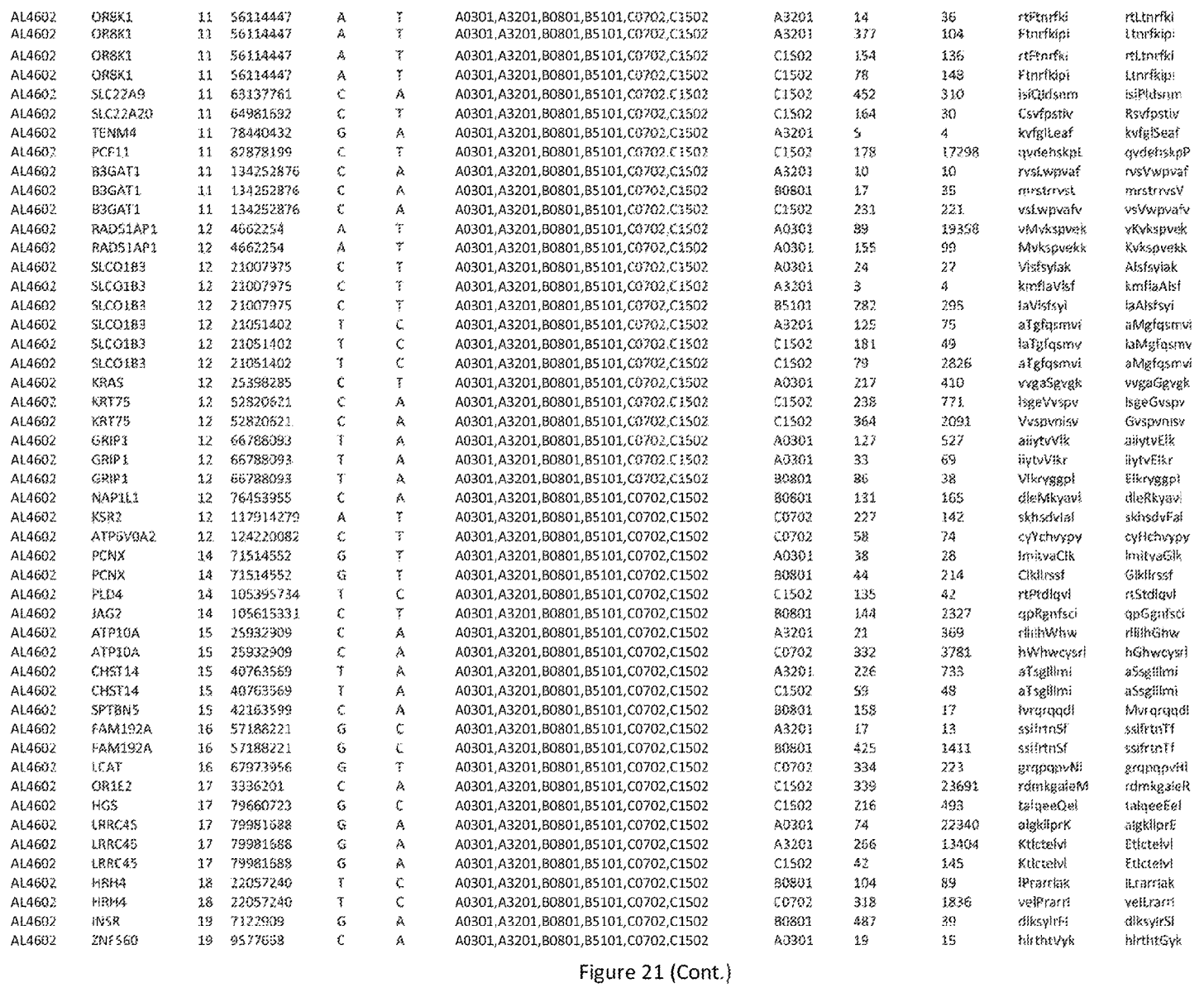
Figure 21:
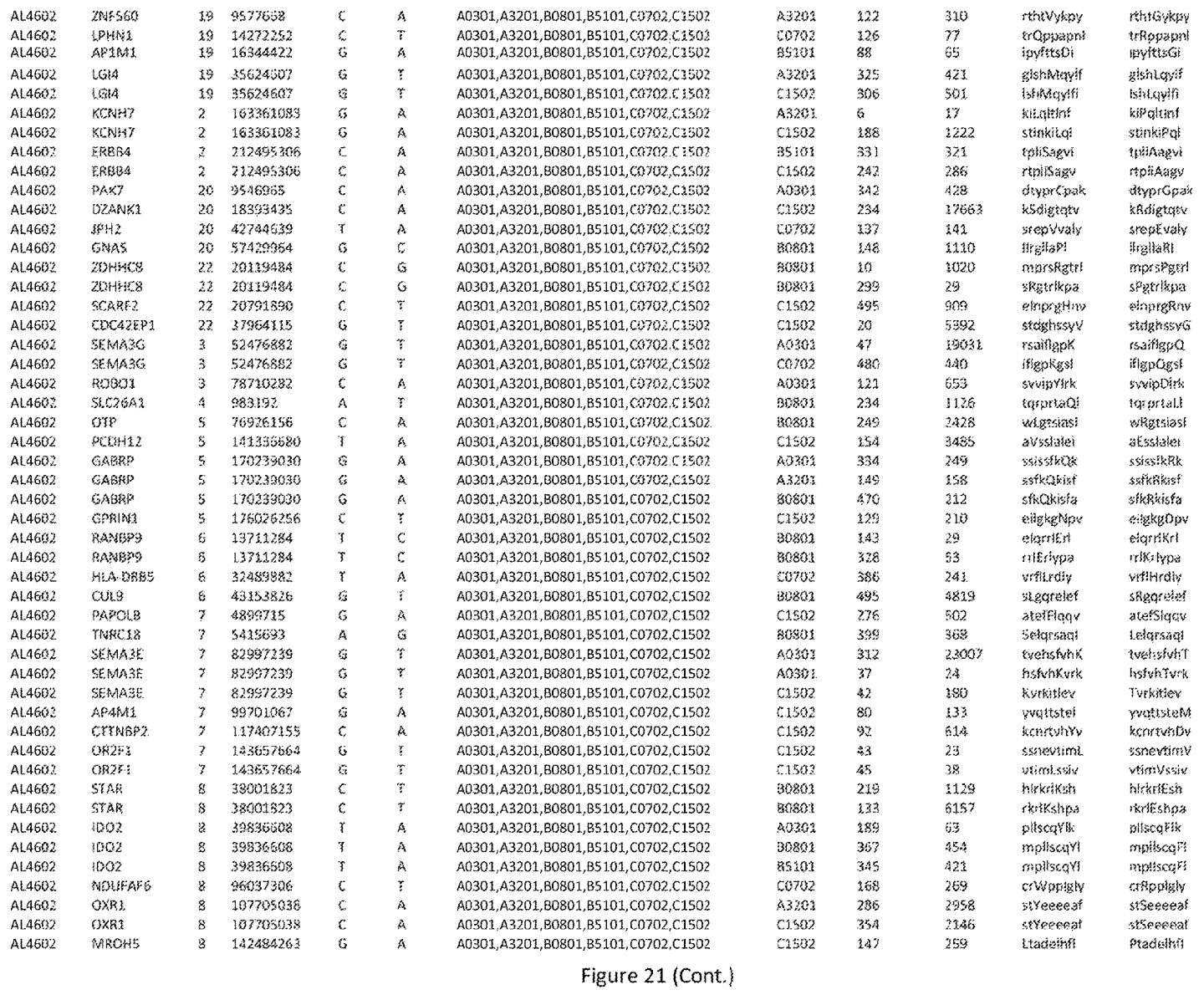
Figure 21:
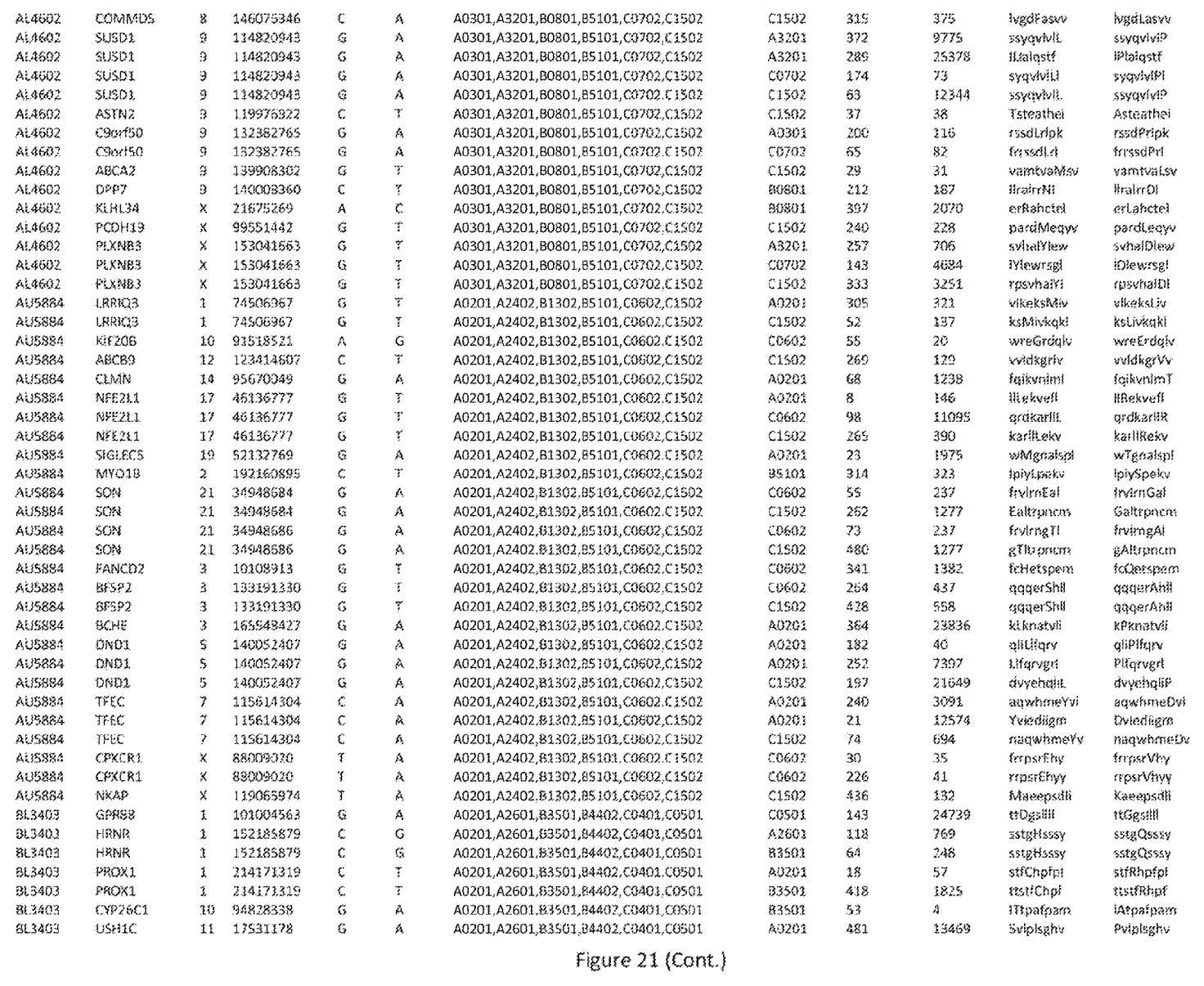
Figure 21:
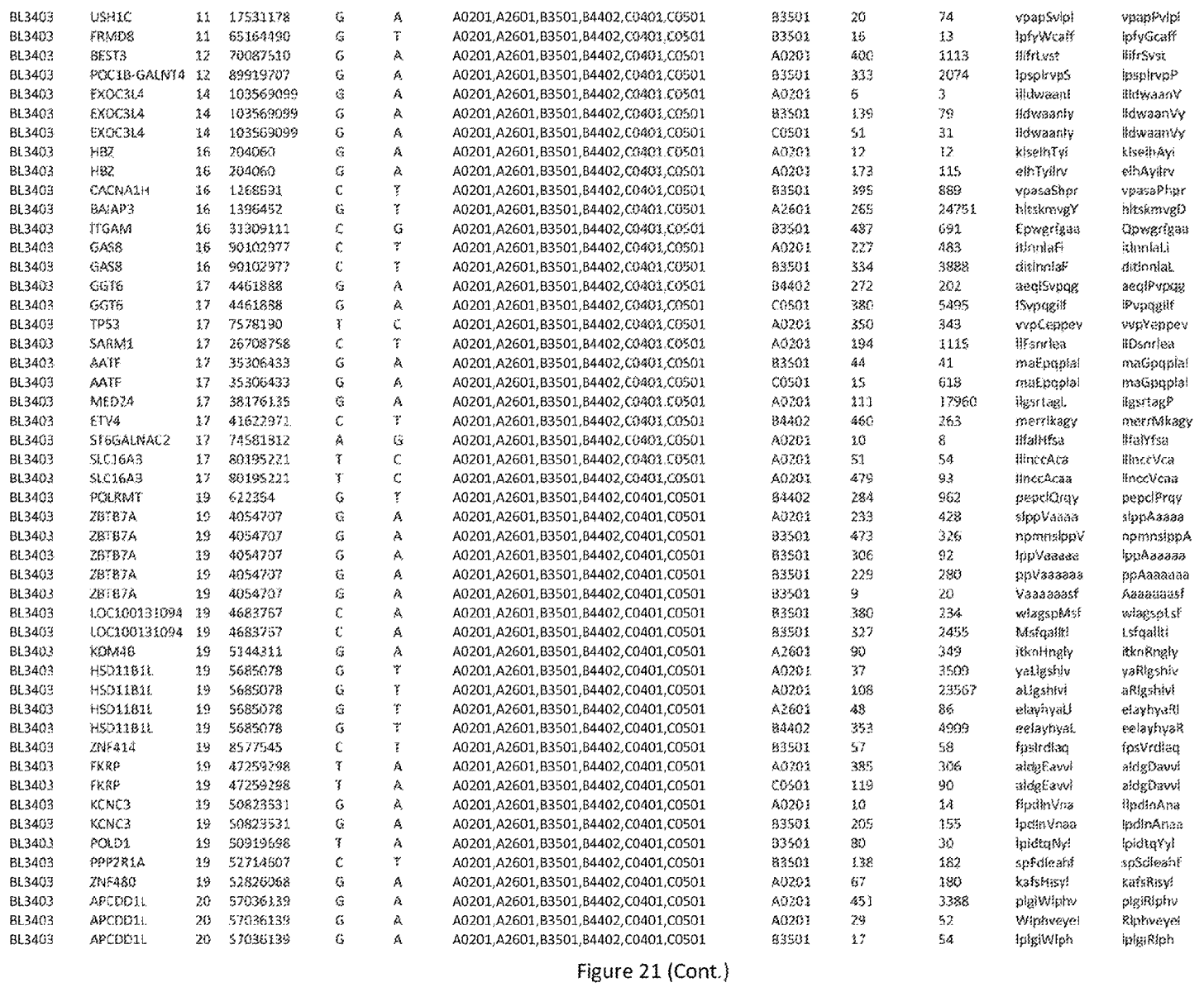
Figure 21:
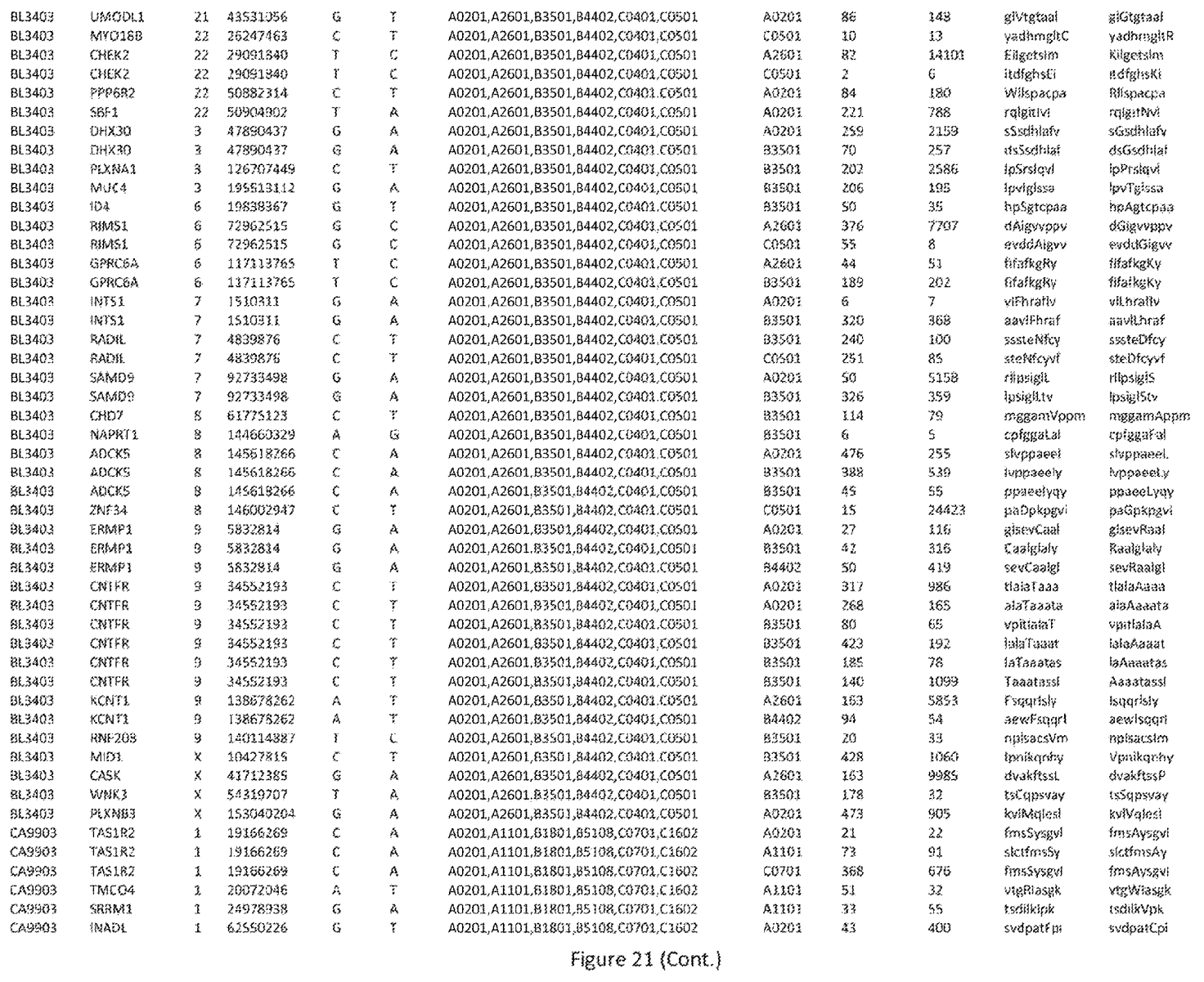
Figure 21:
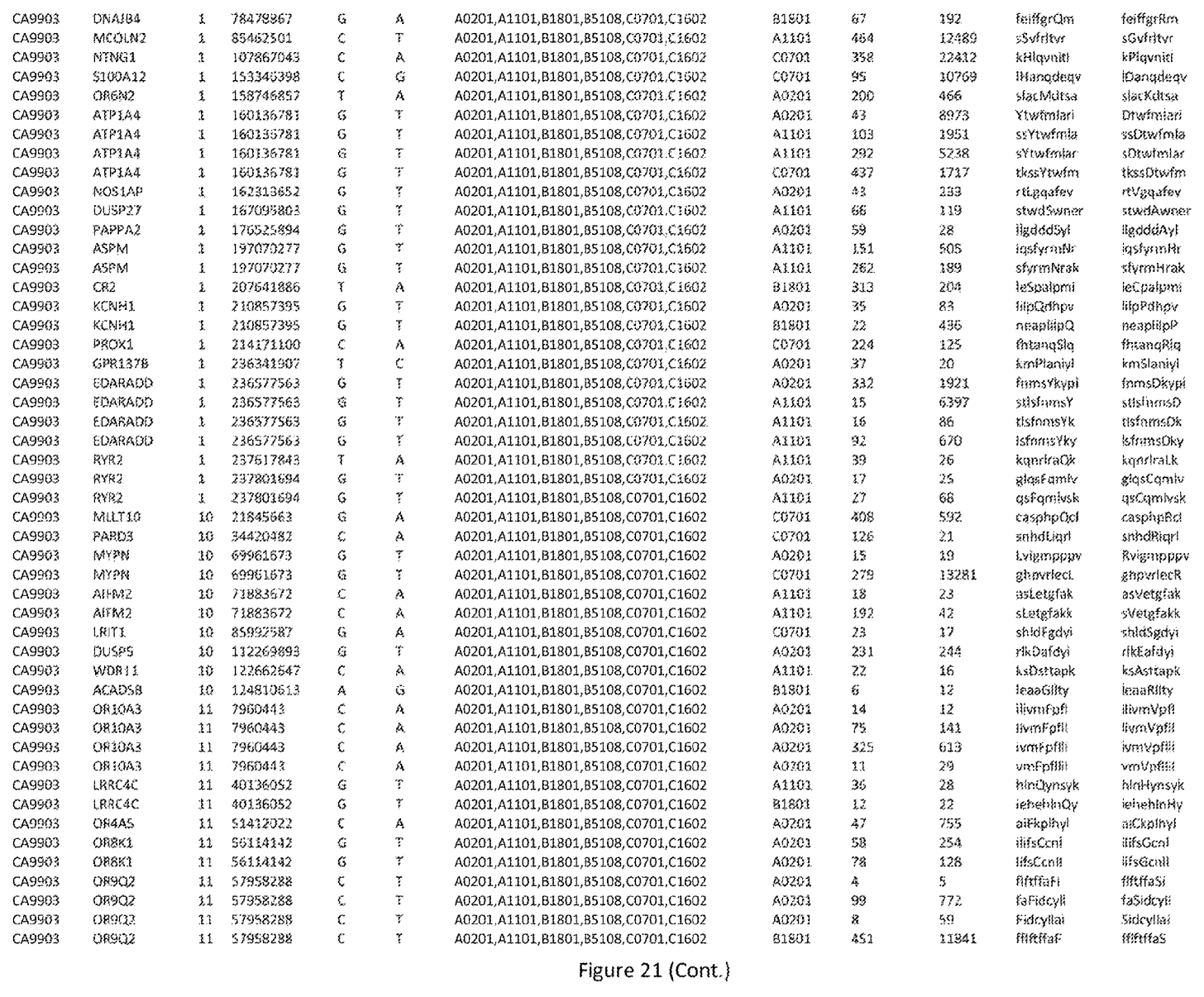
Figure 21:
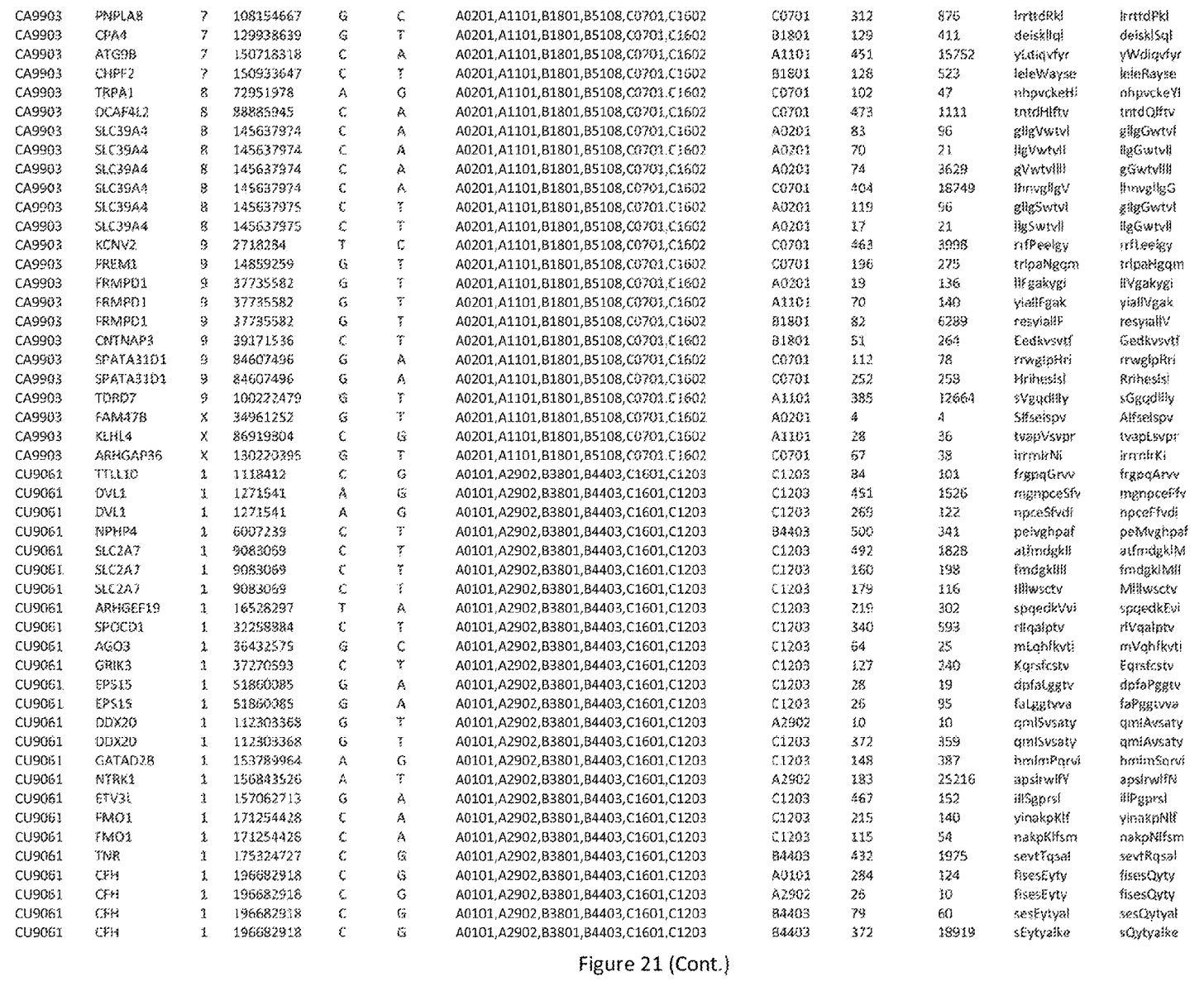
Figure 21:
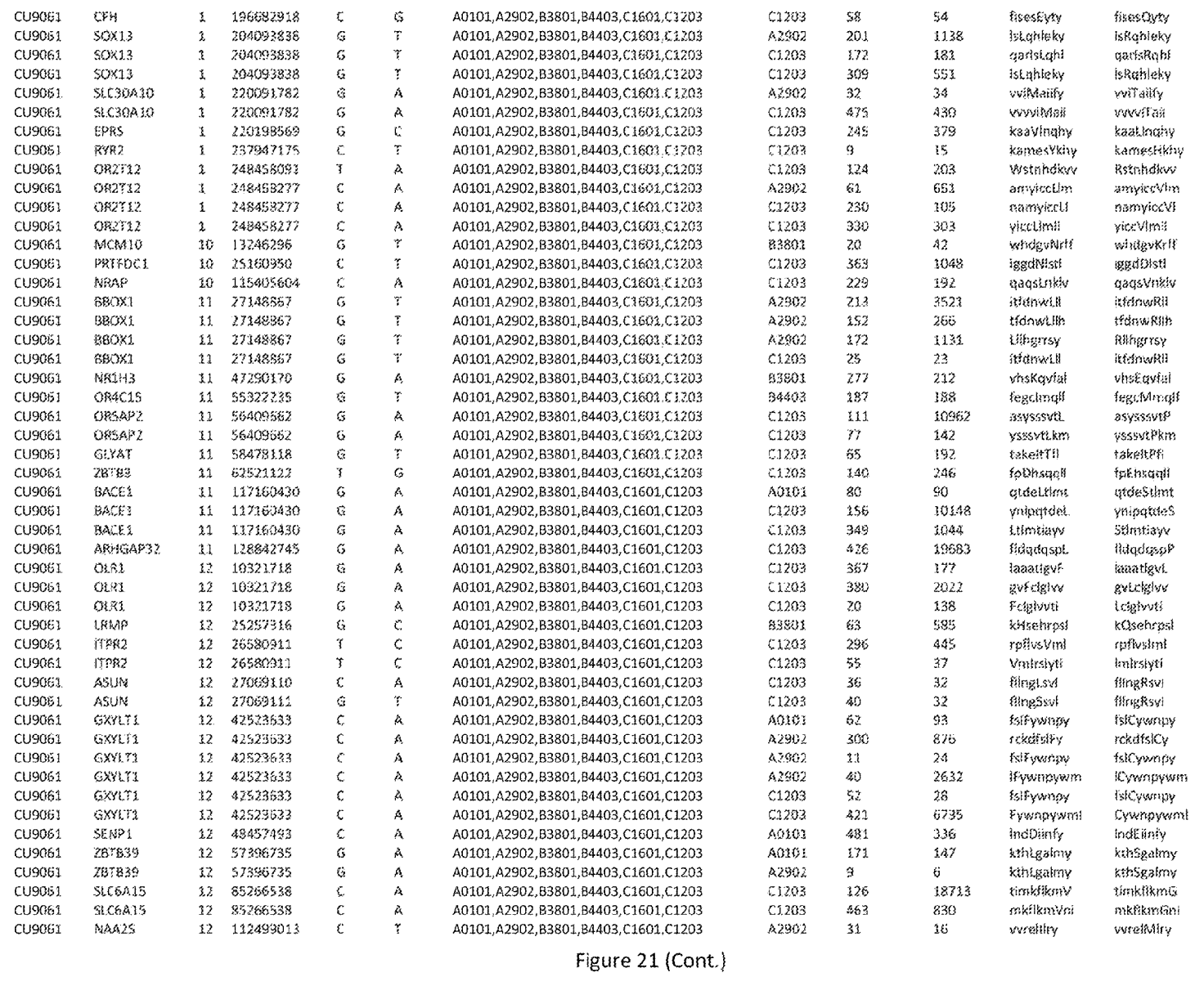
Figure 21:
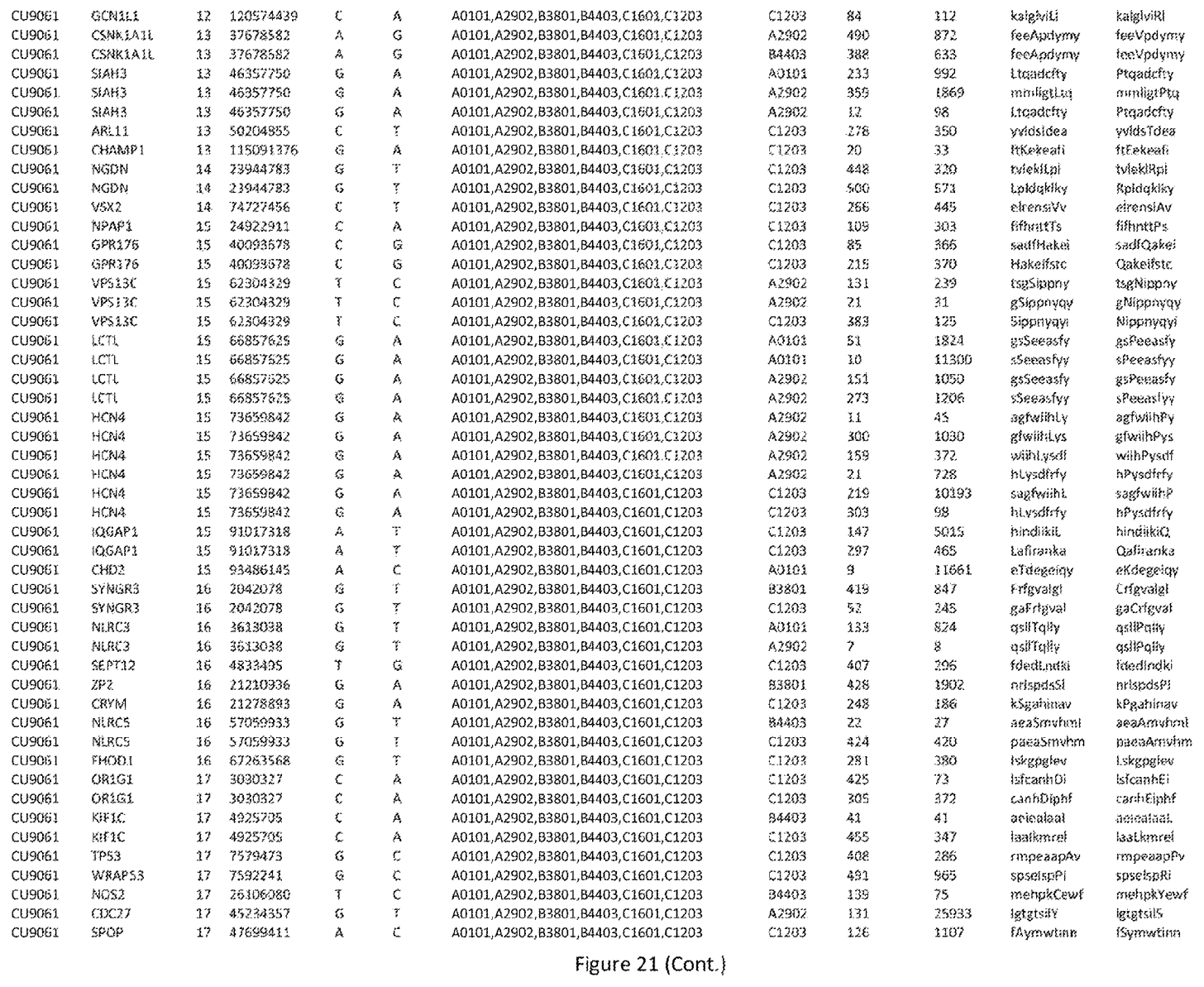
Figure 21:
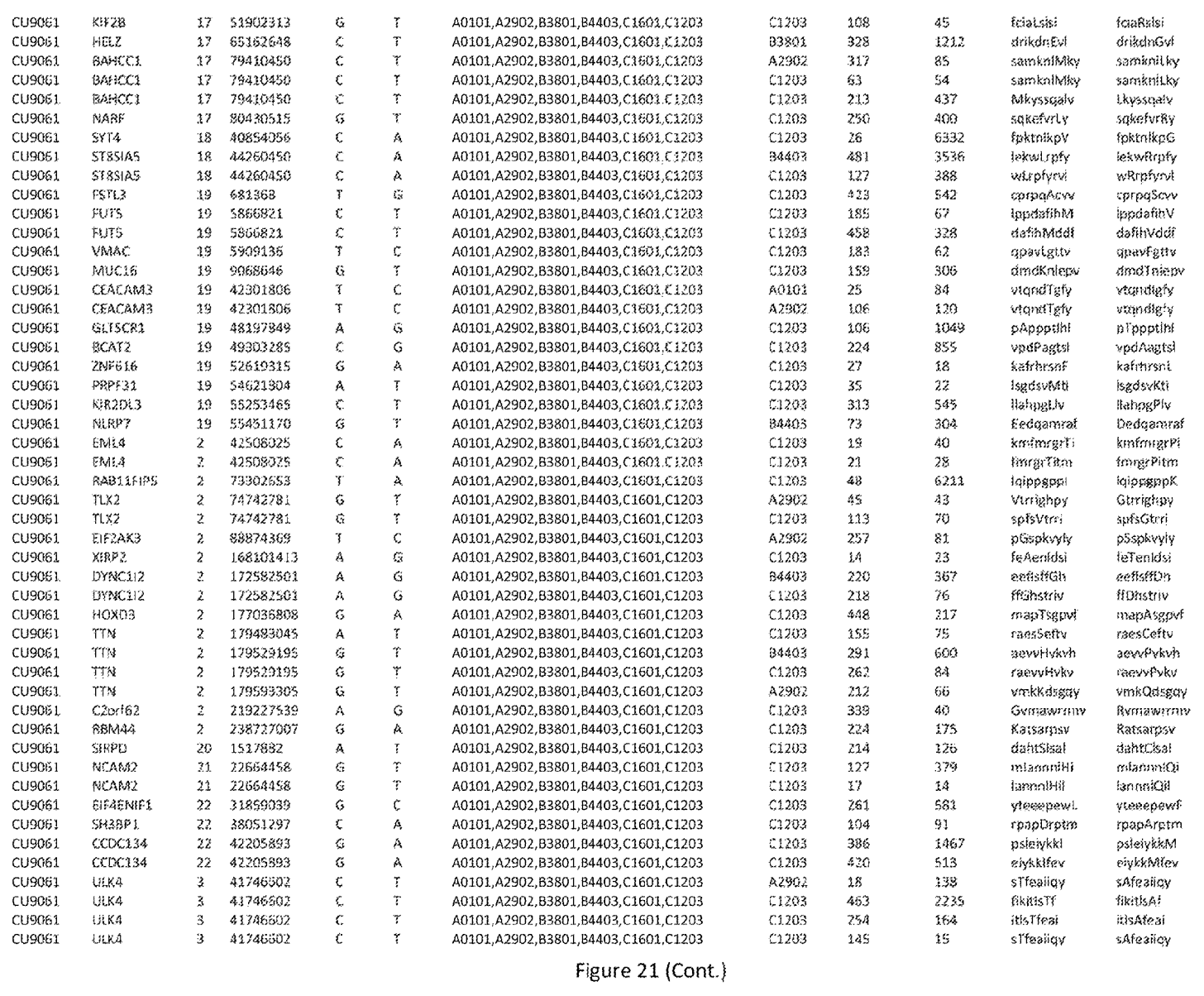
Figure 21:
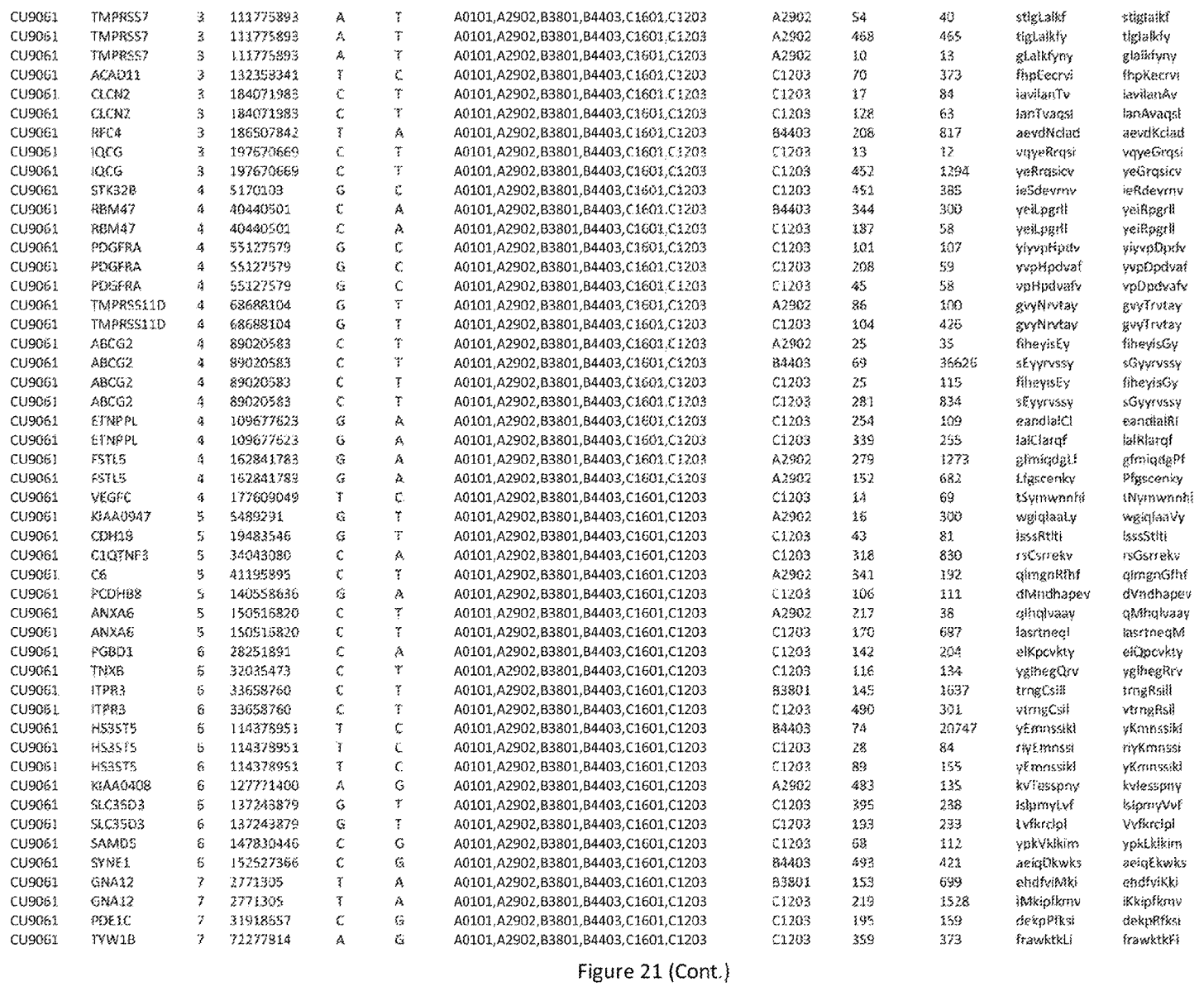
Figure 21:
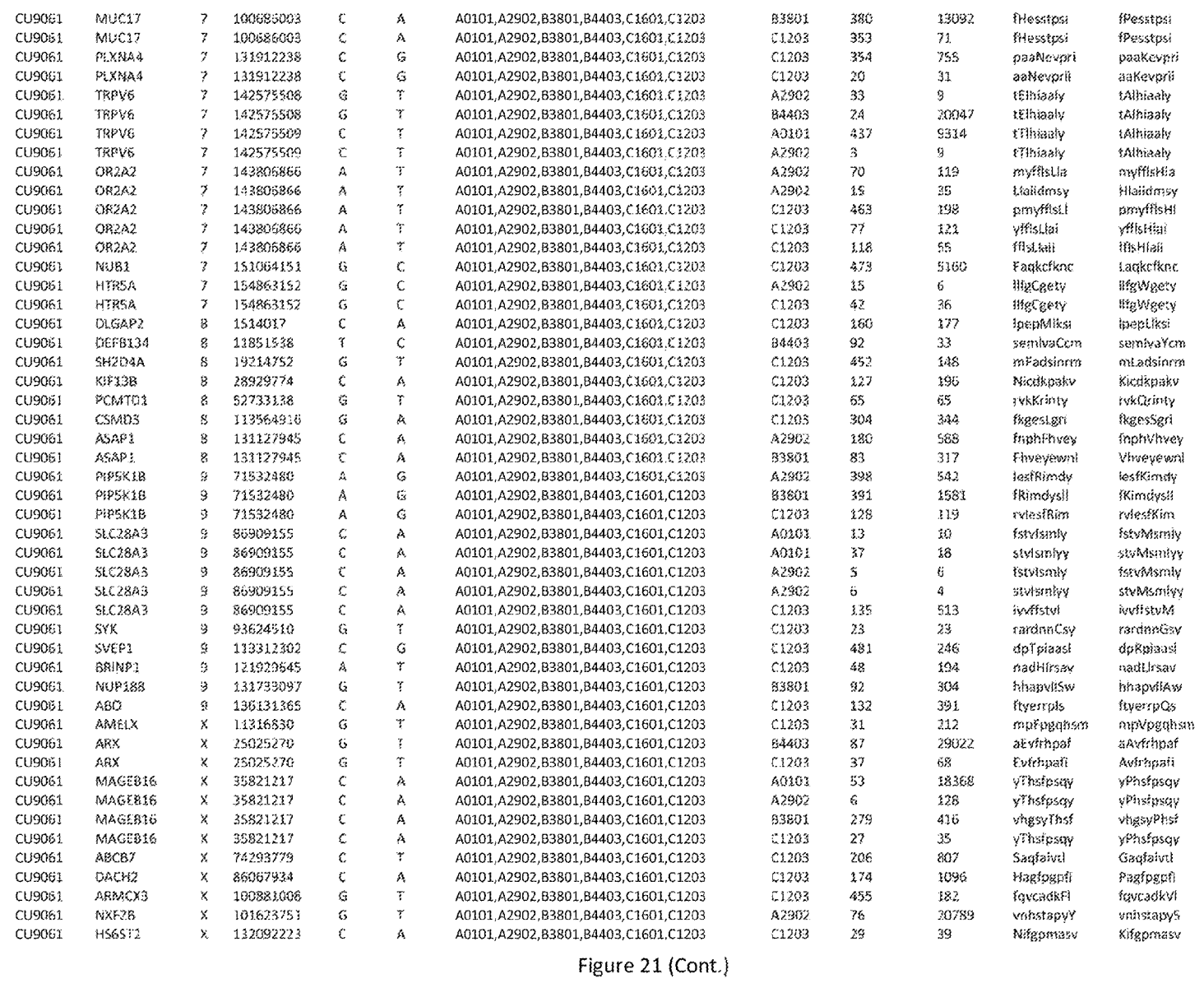
Figure 21:
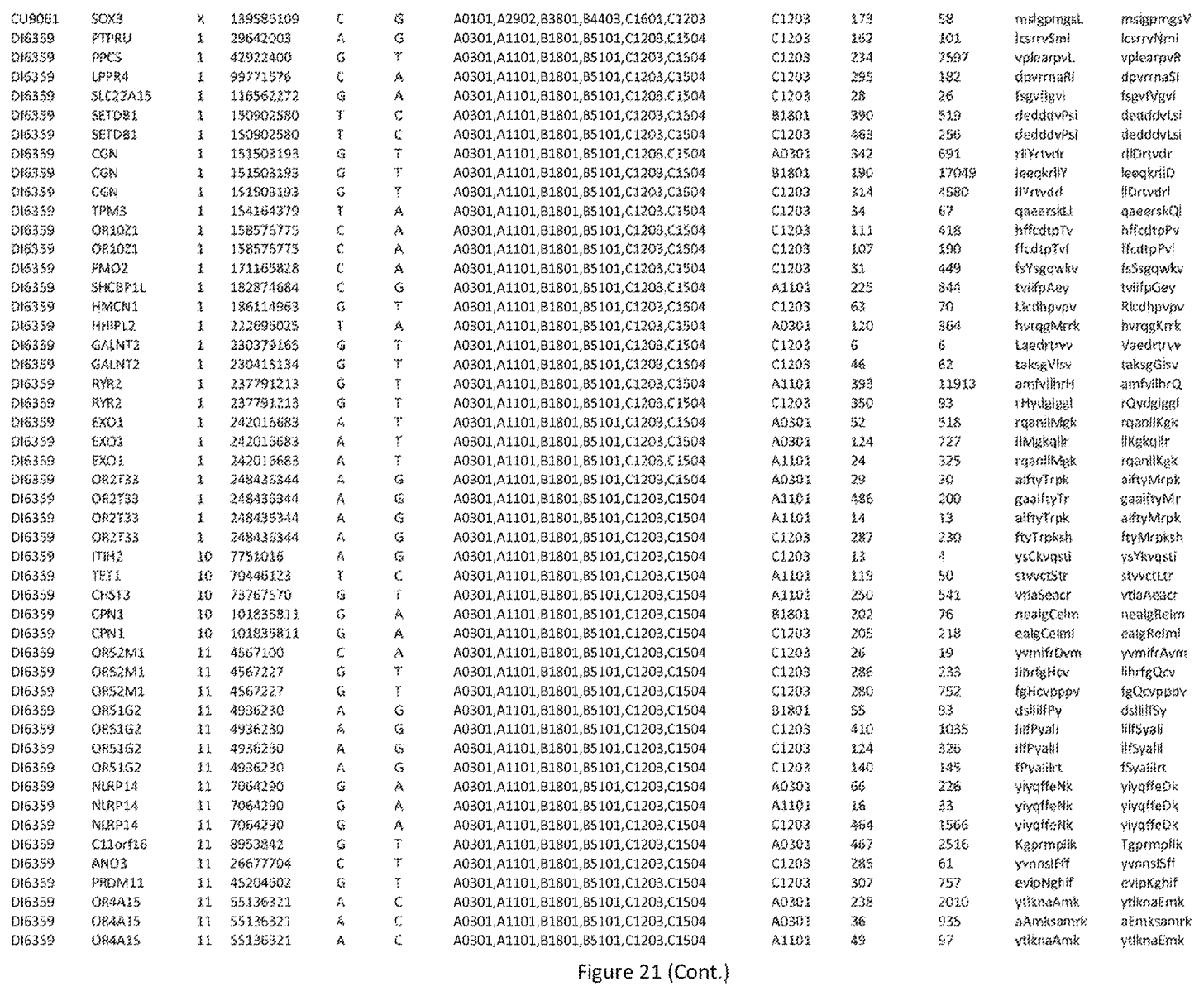
Figure 21:
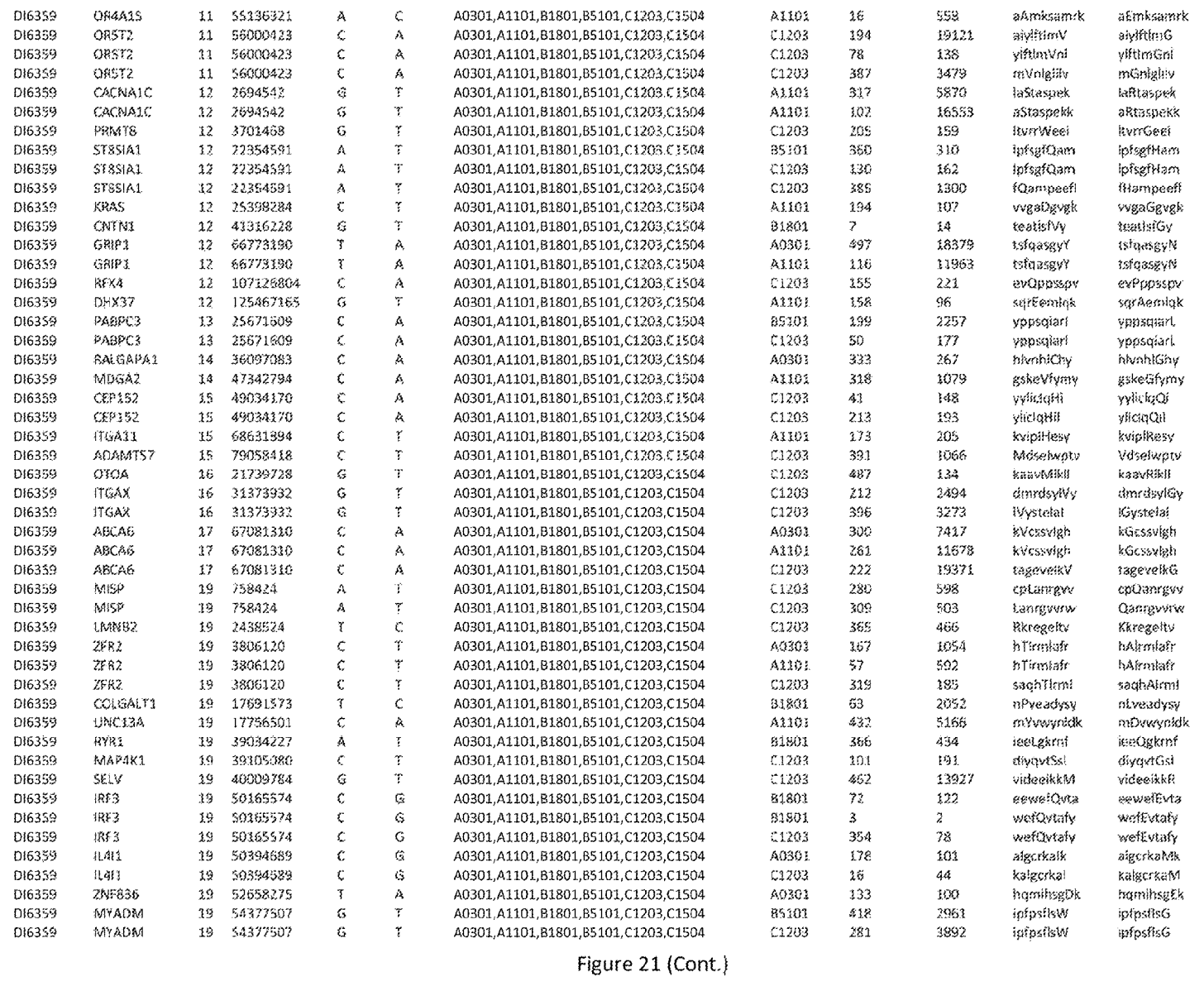
Figure 21:
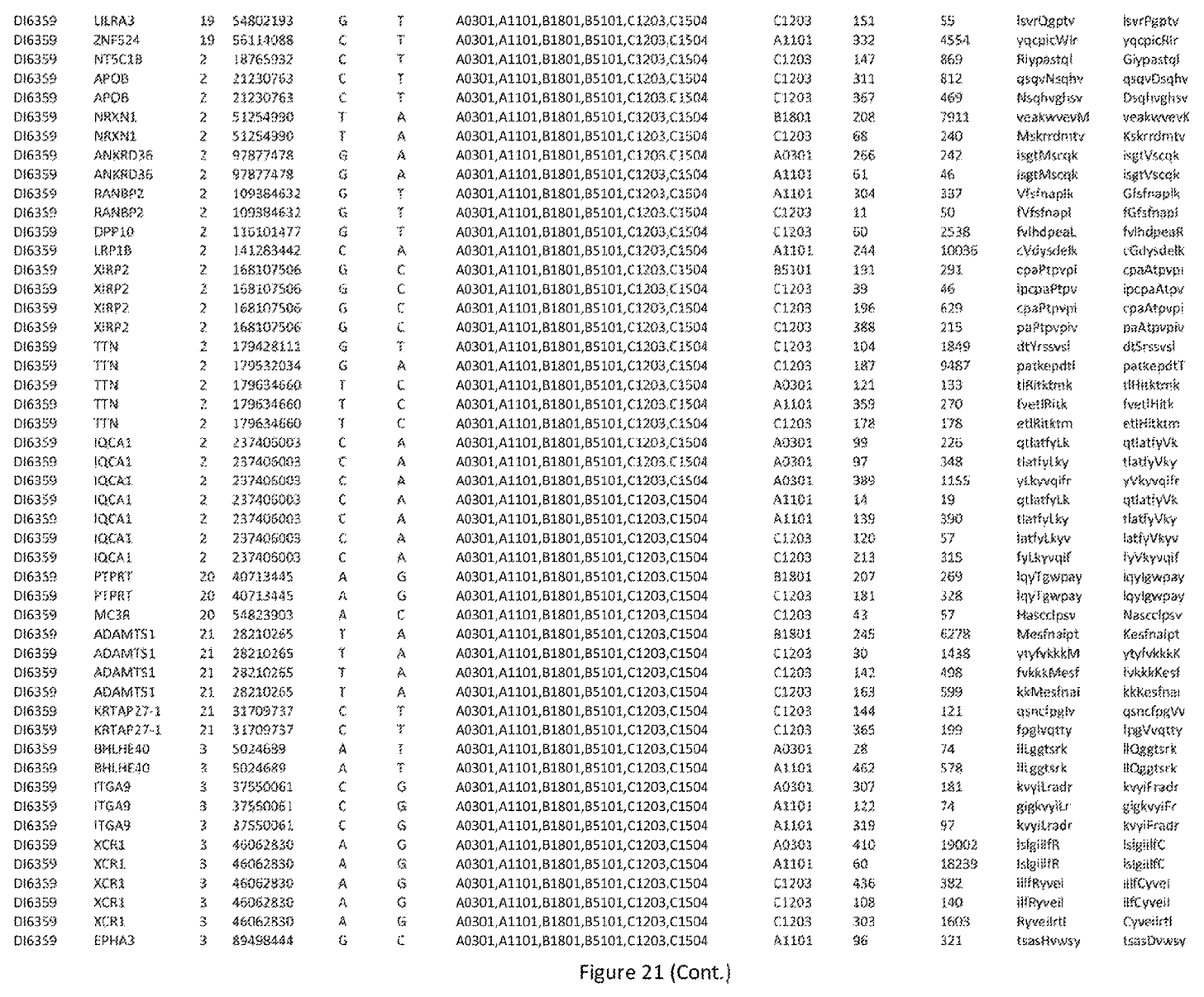
Figure 21:
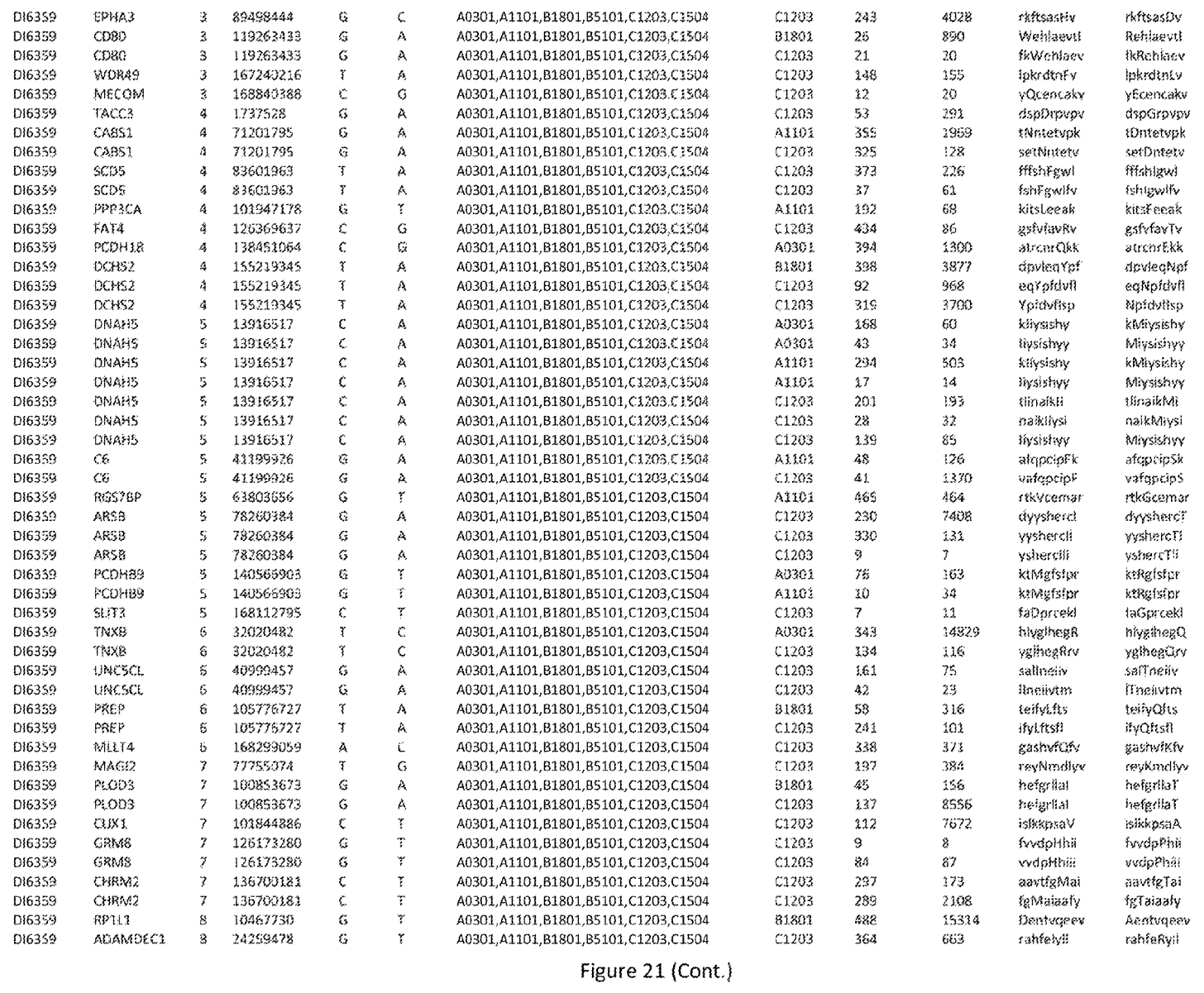
Figure 21:
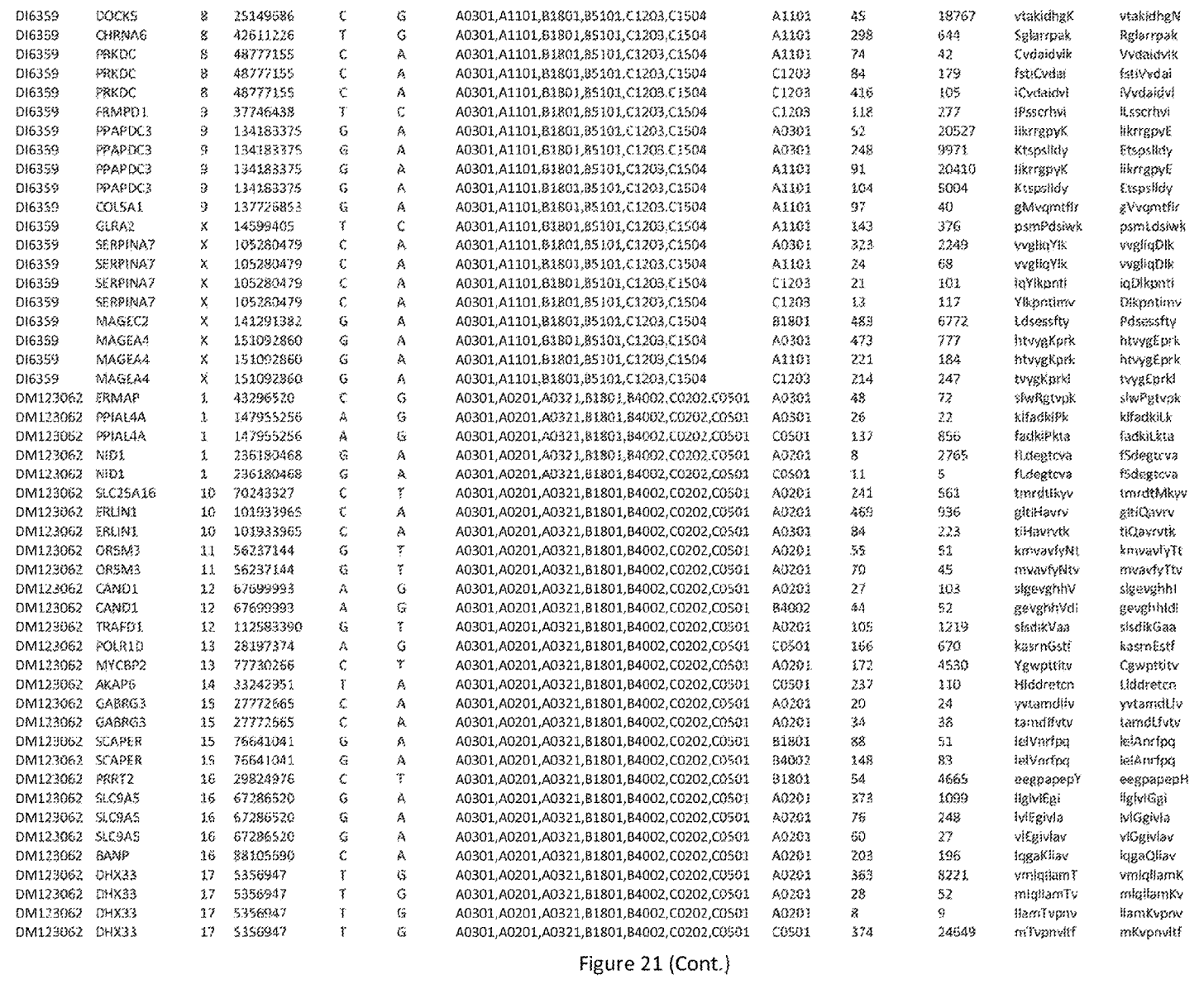
Figure 21:
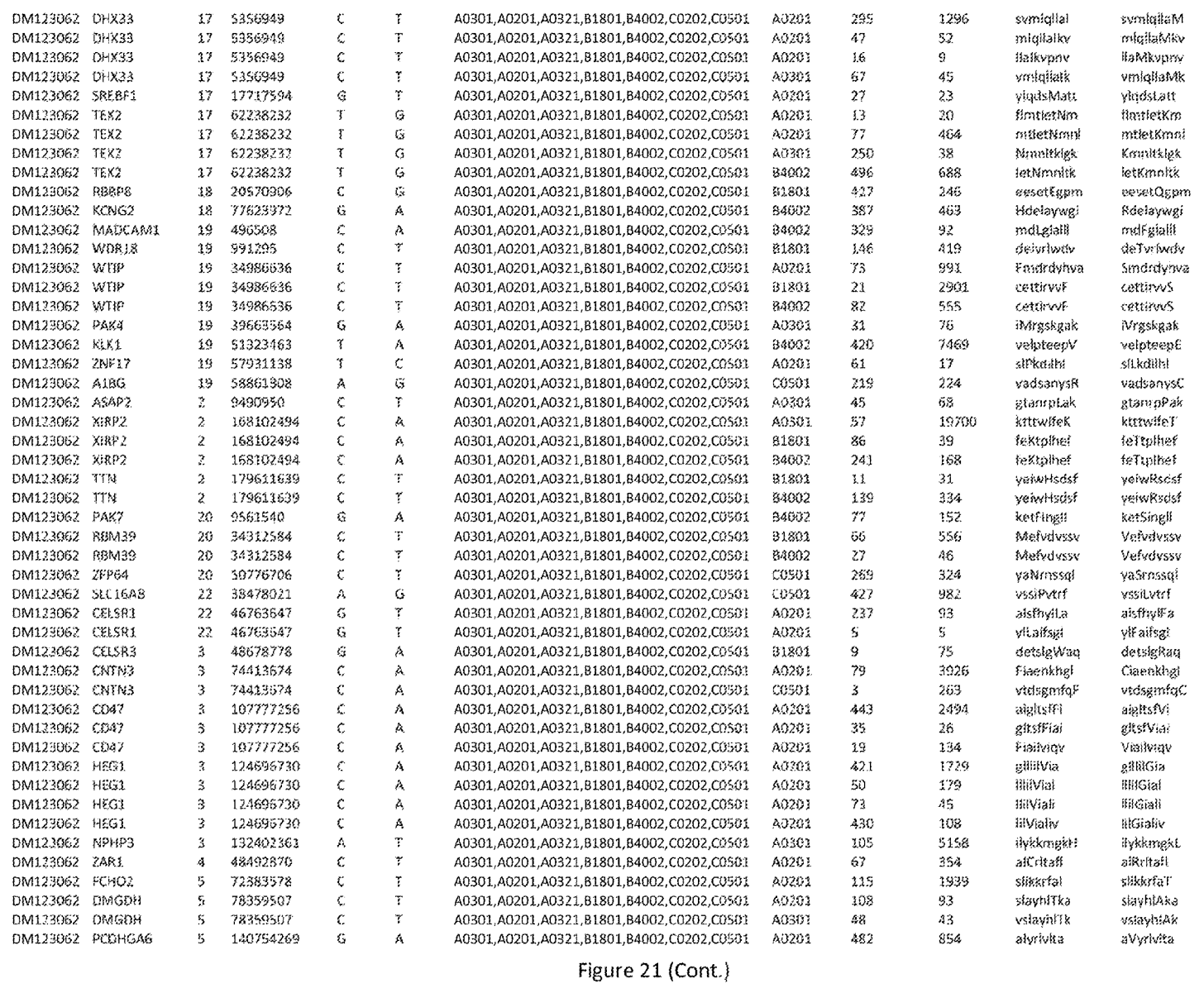
Figure 21:
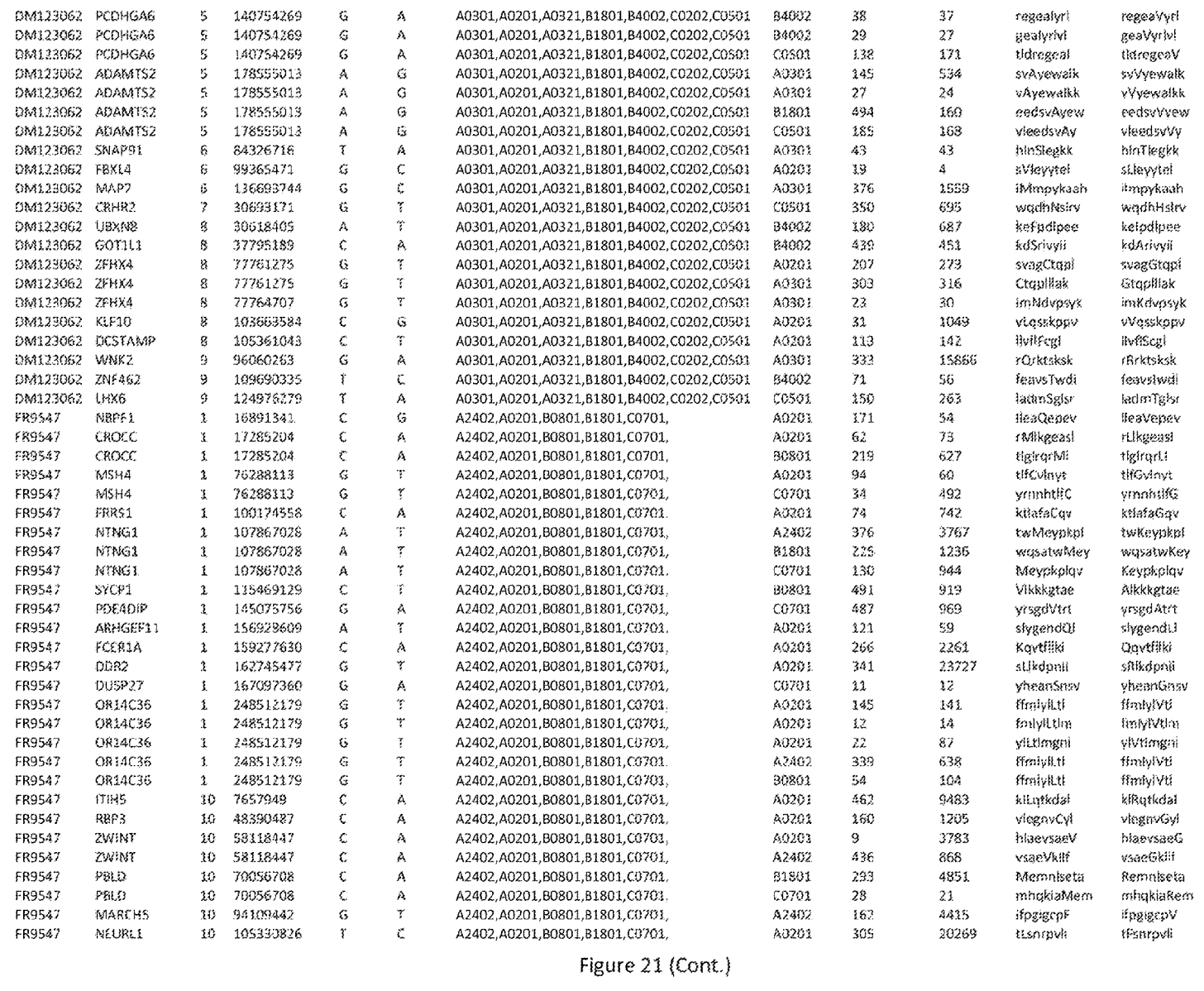
Figure 21:
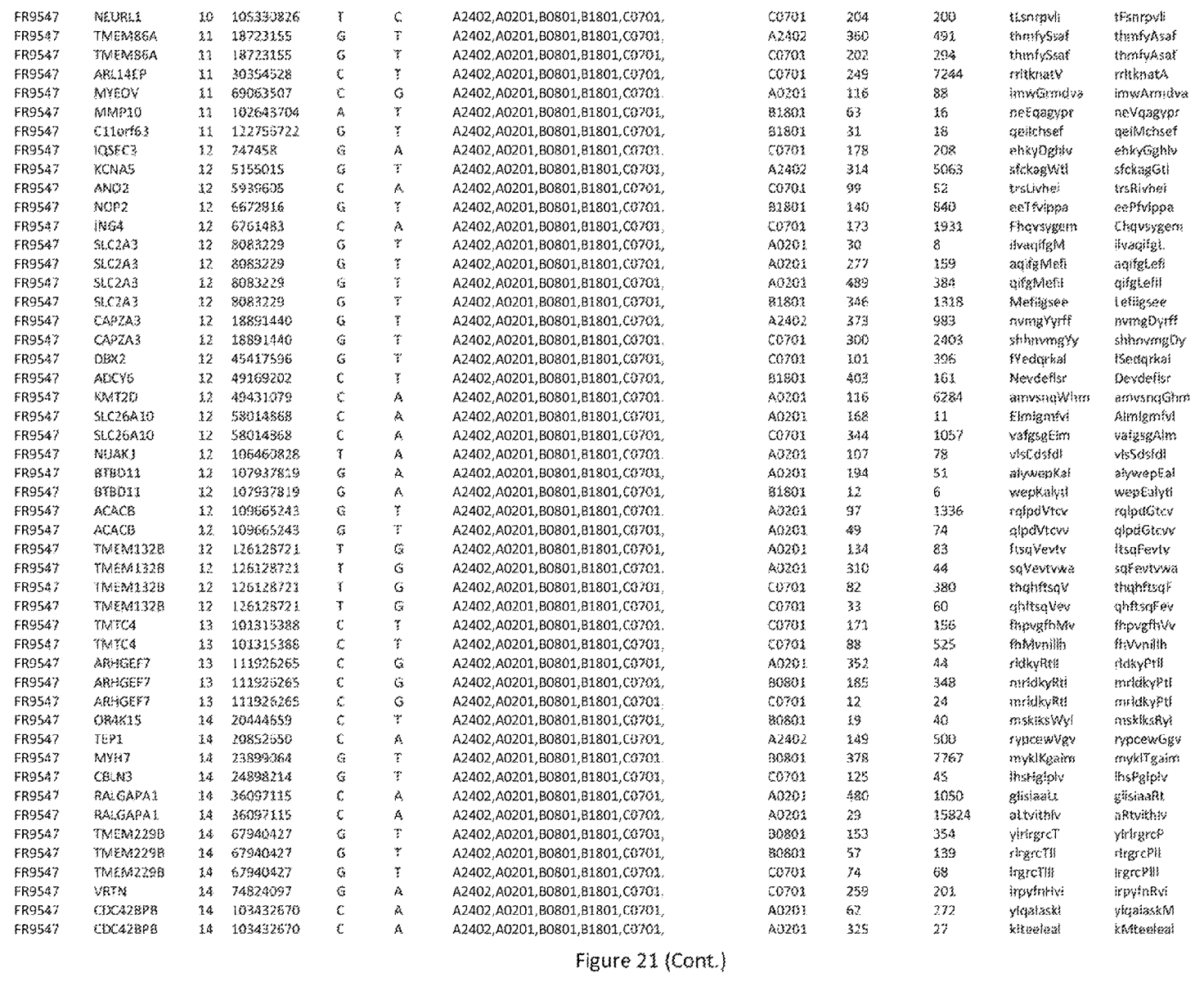
Figure 21:
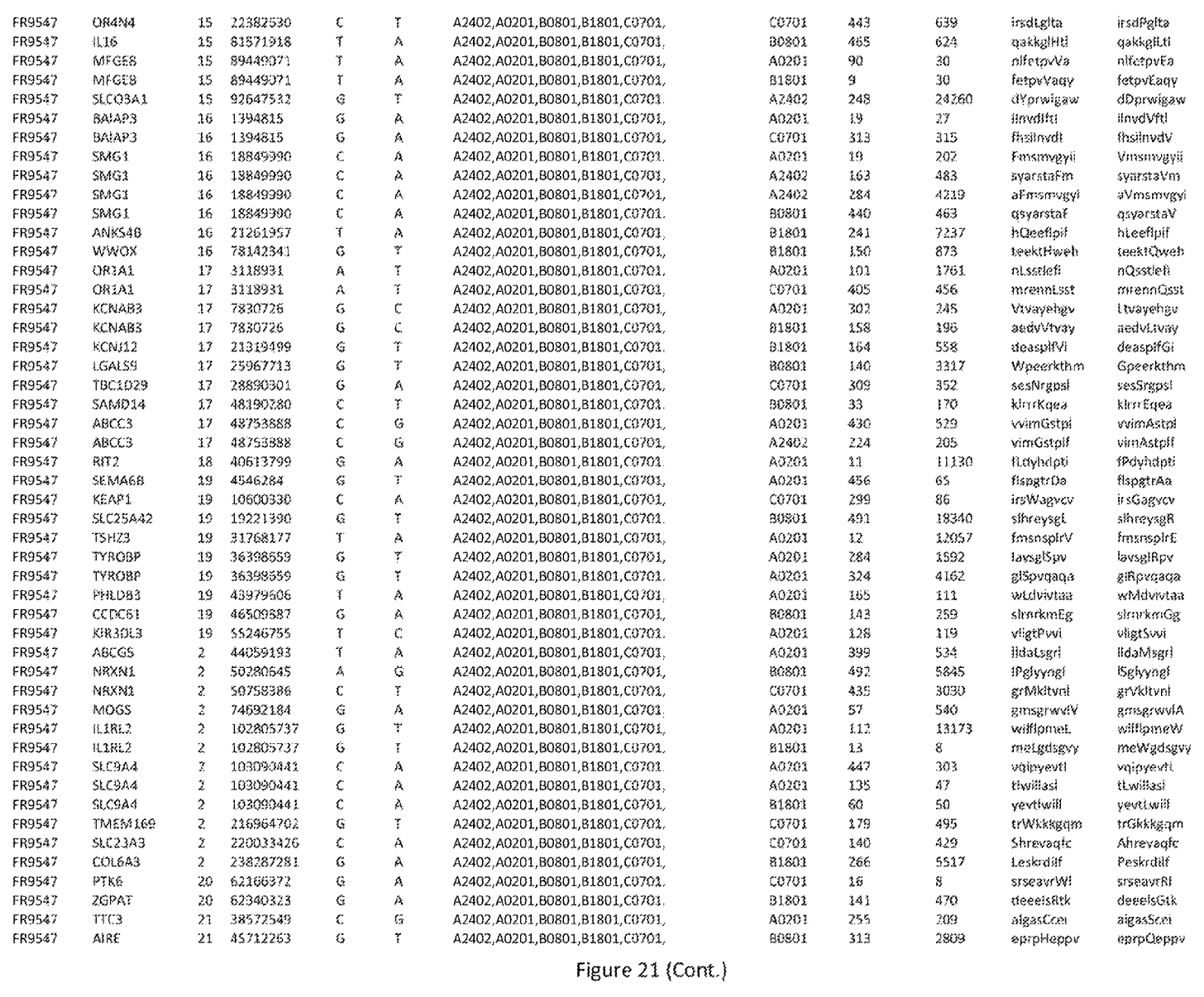
Figure 21:
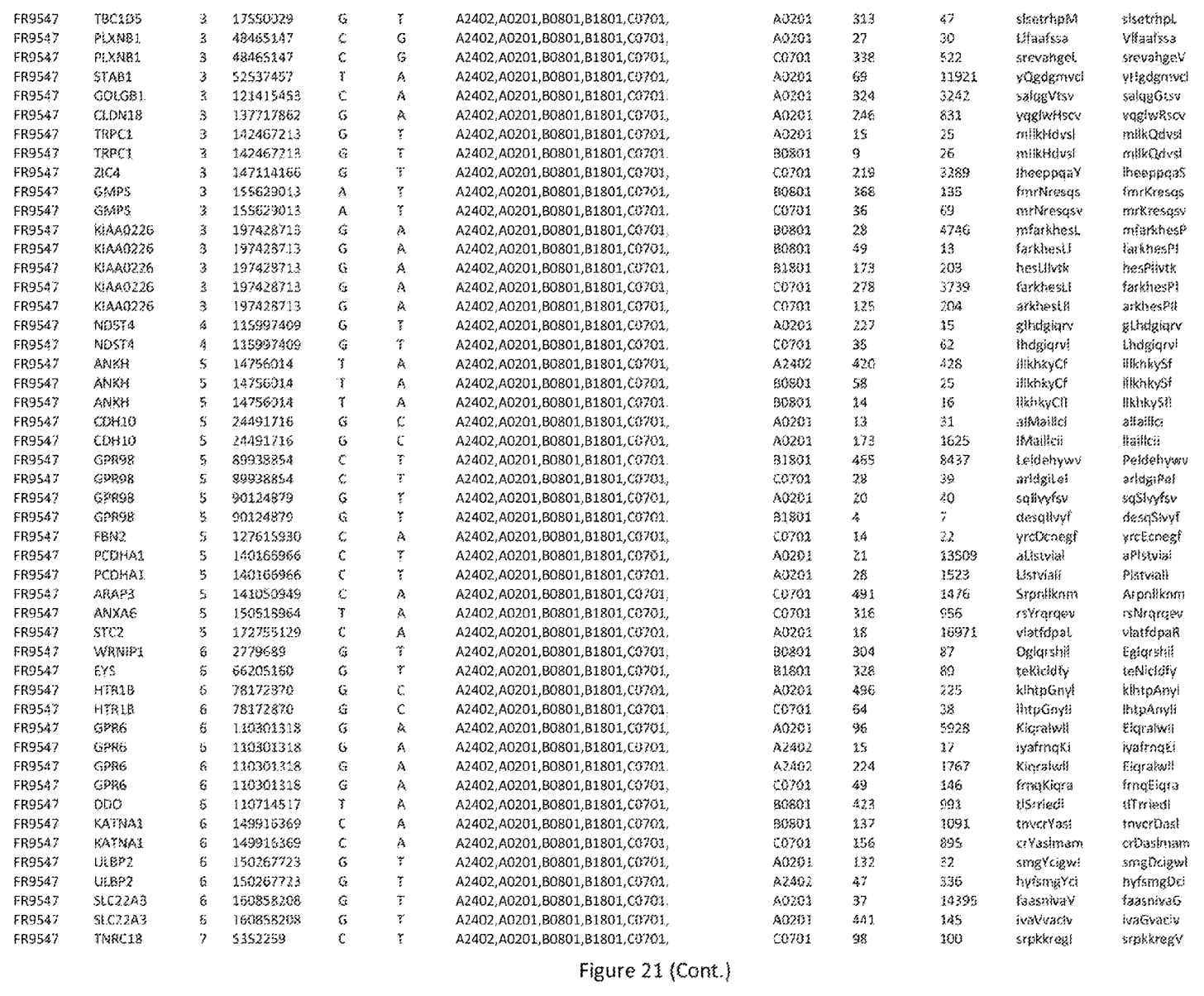
Figure 21:
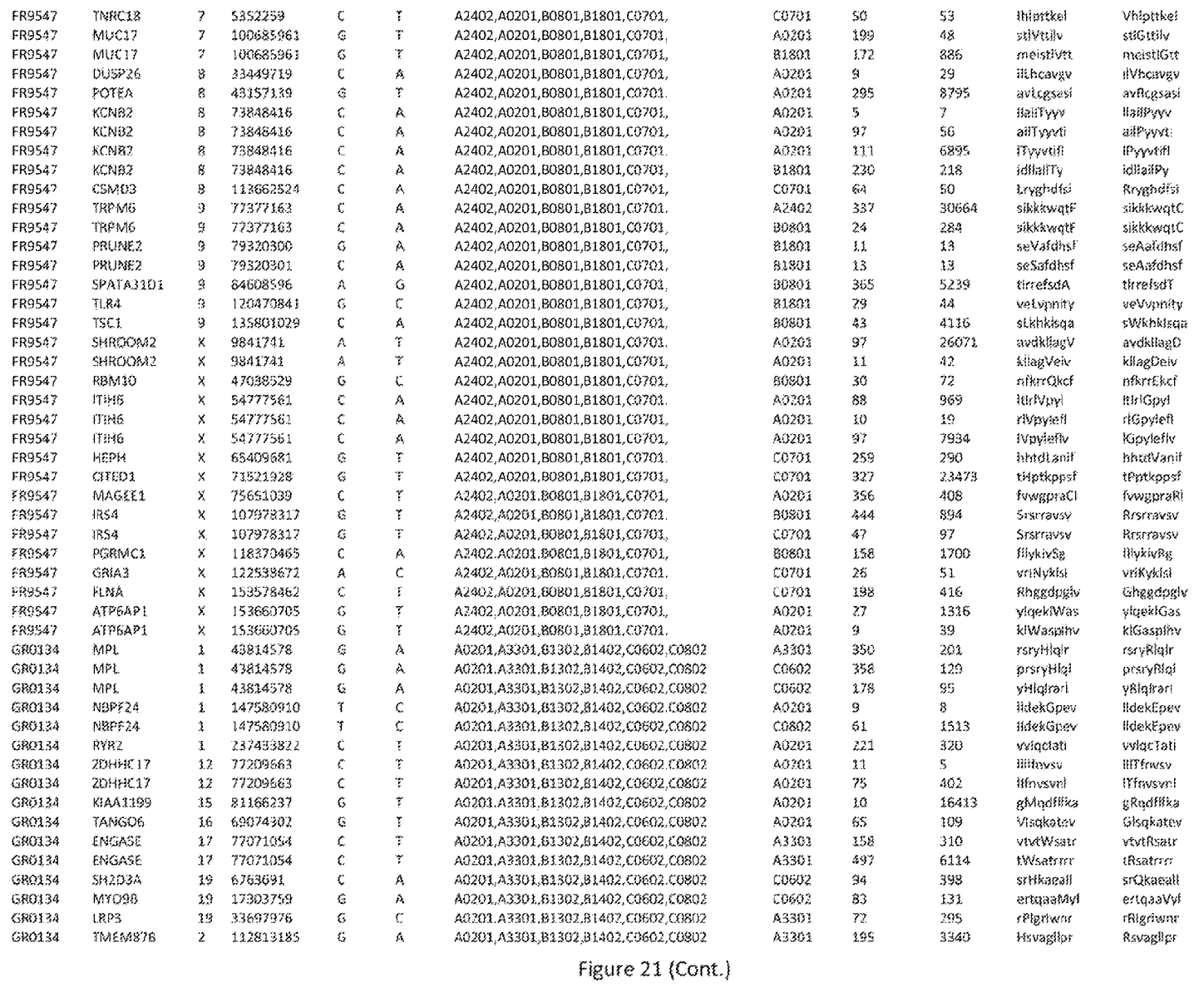
Figure 21:
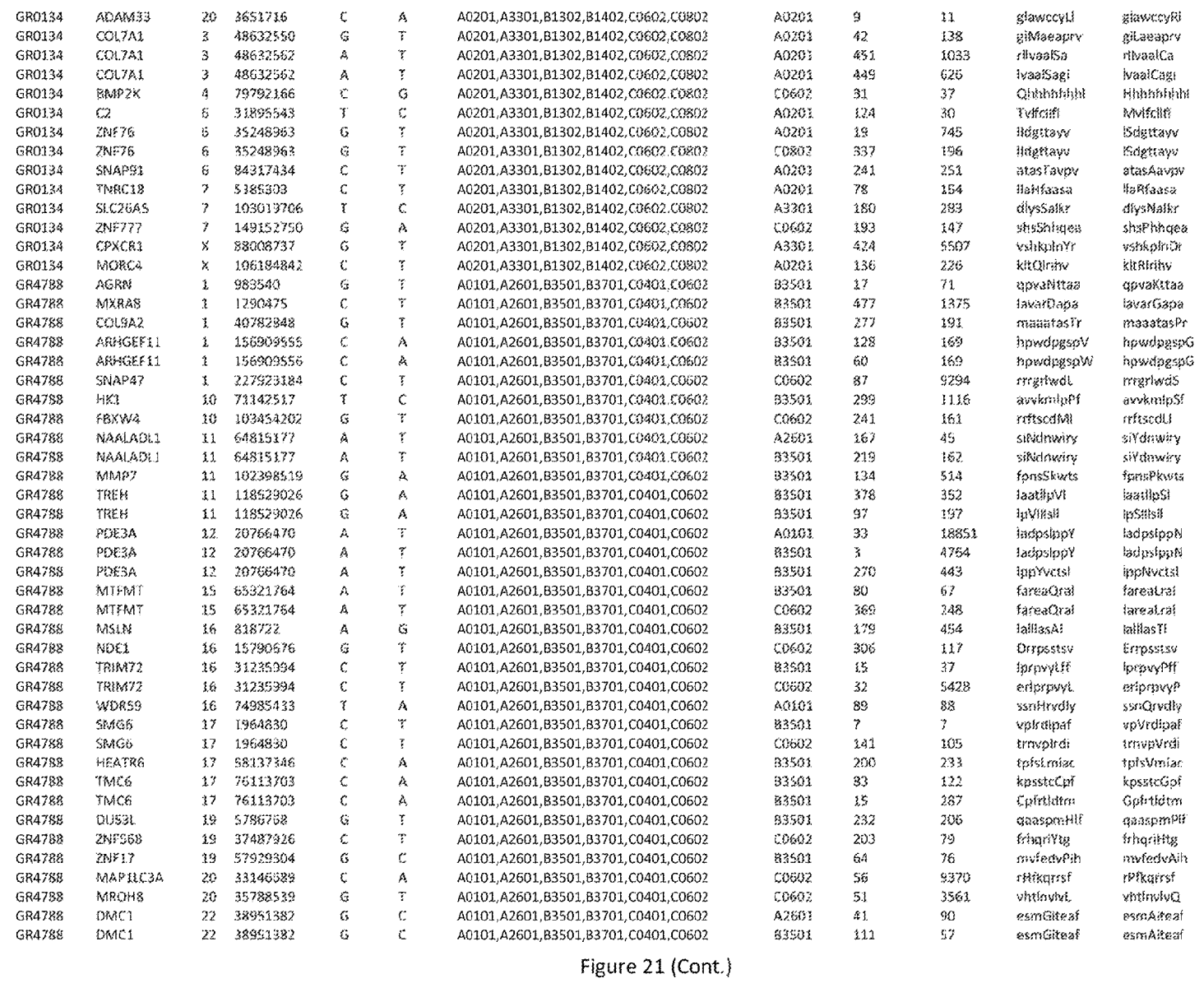
Figure 21:
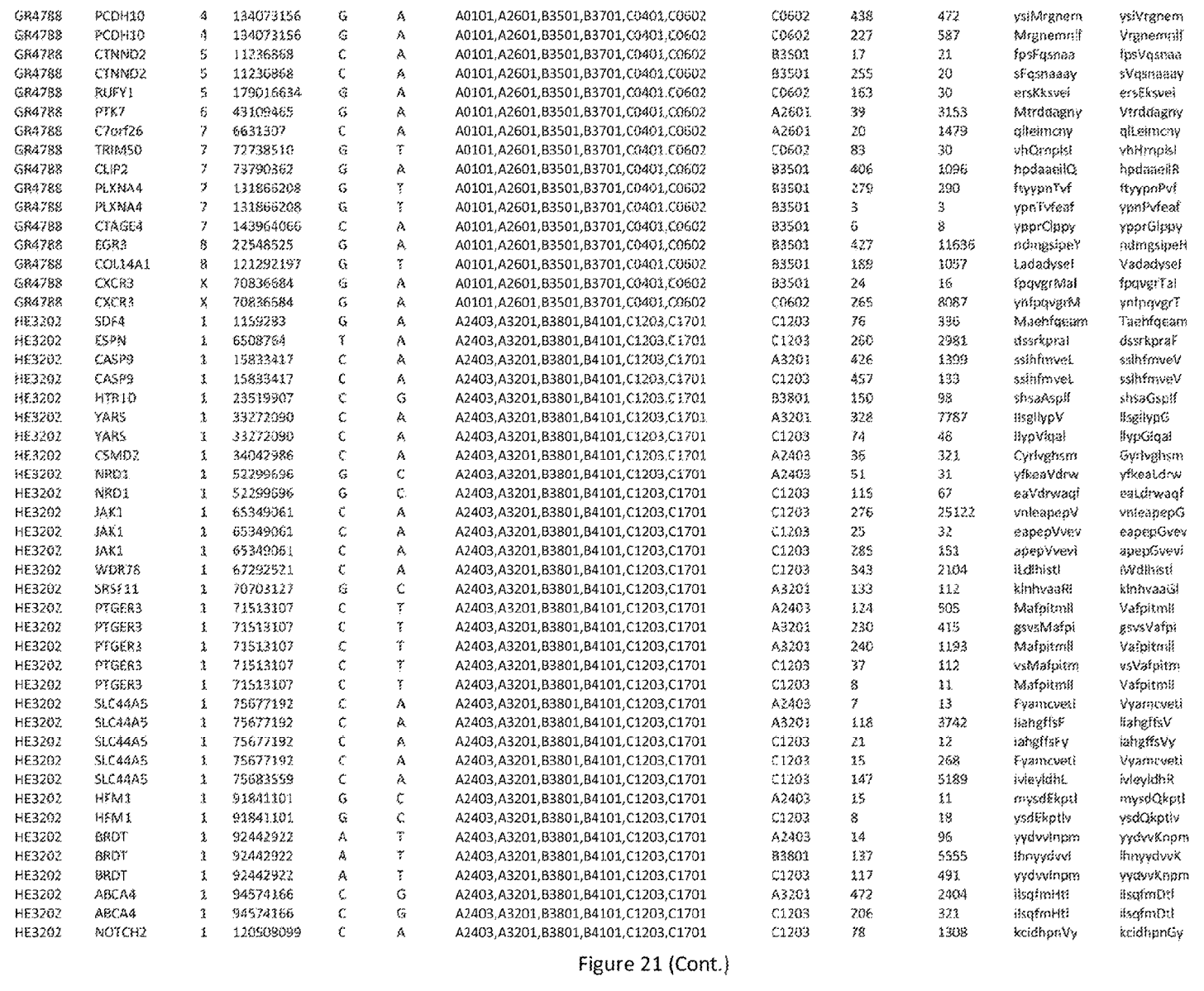
Figure 21:
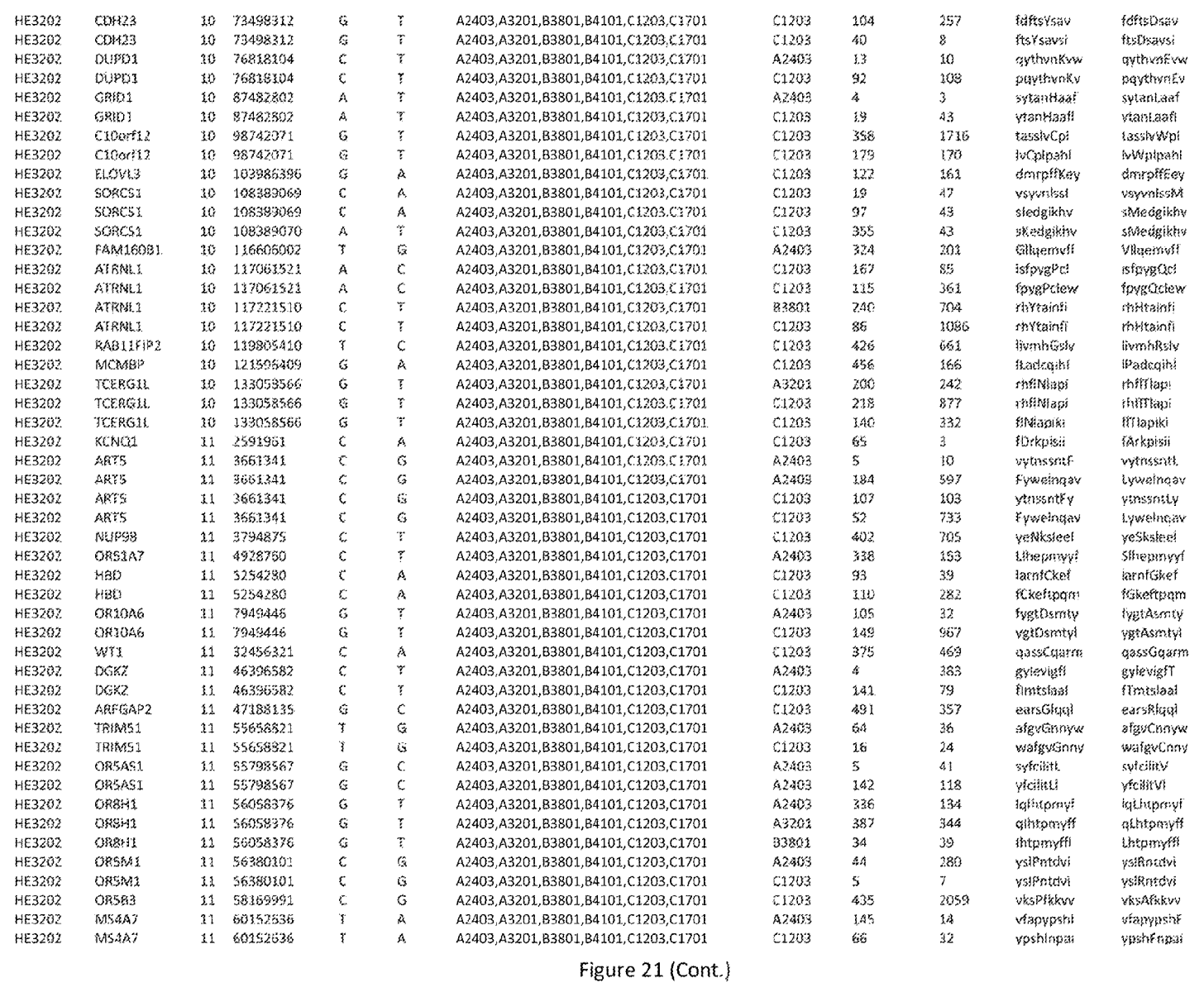
Figure 21:
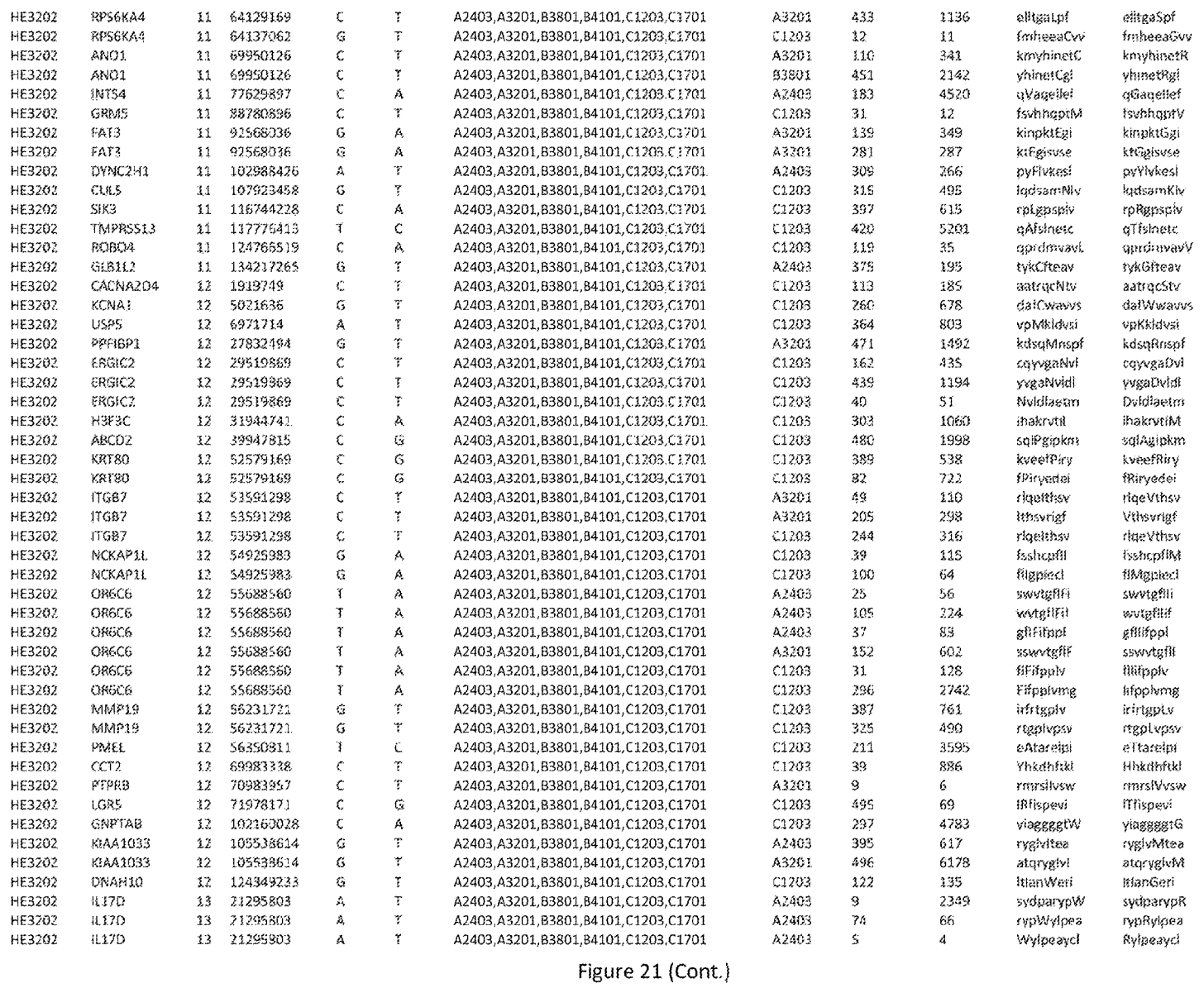
Figure 21:
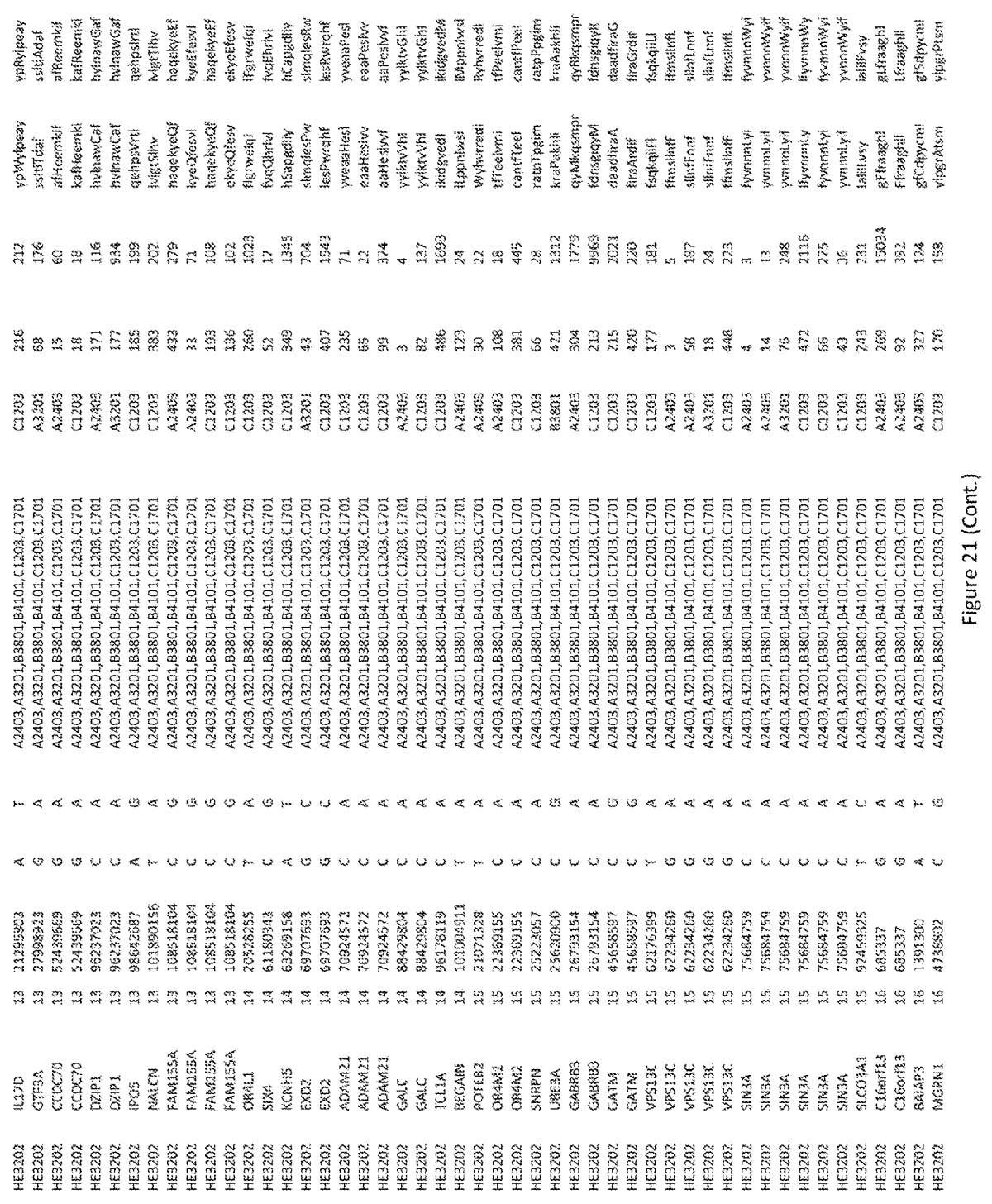
Figure 21:
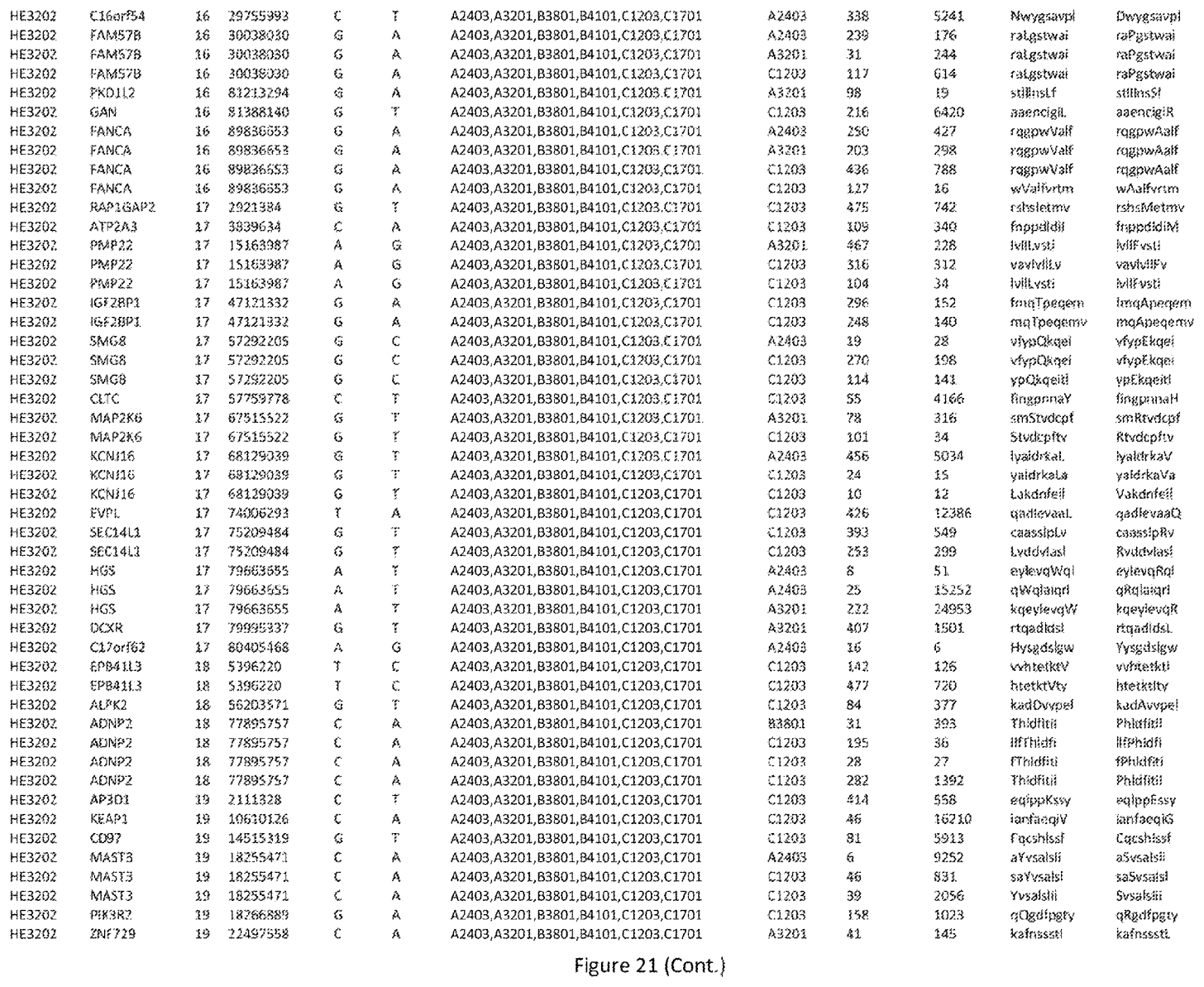
Figure 21:
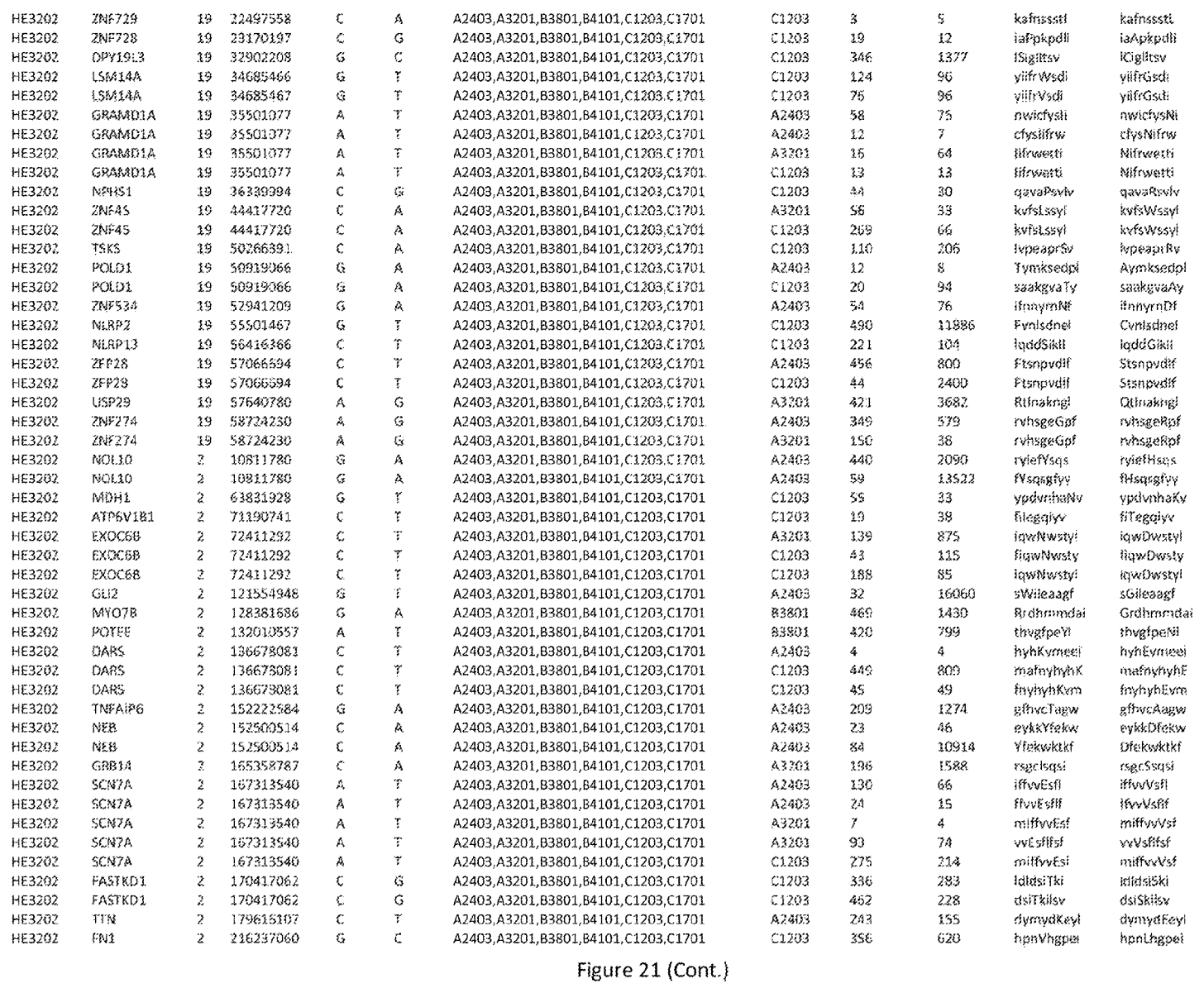
Figure 21:
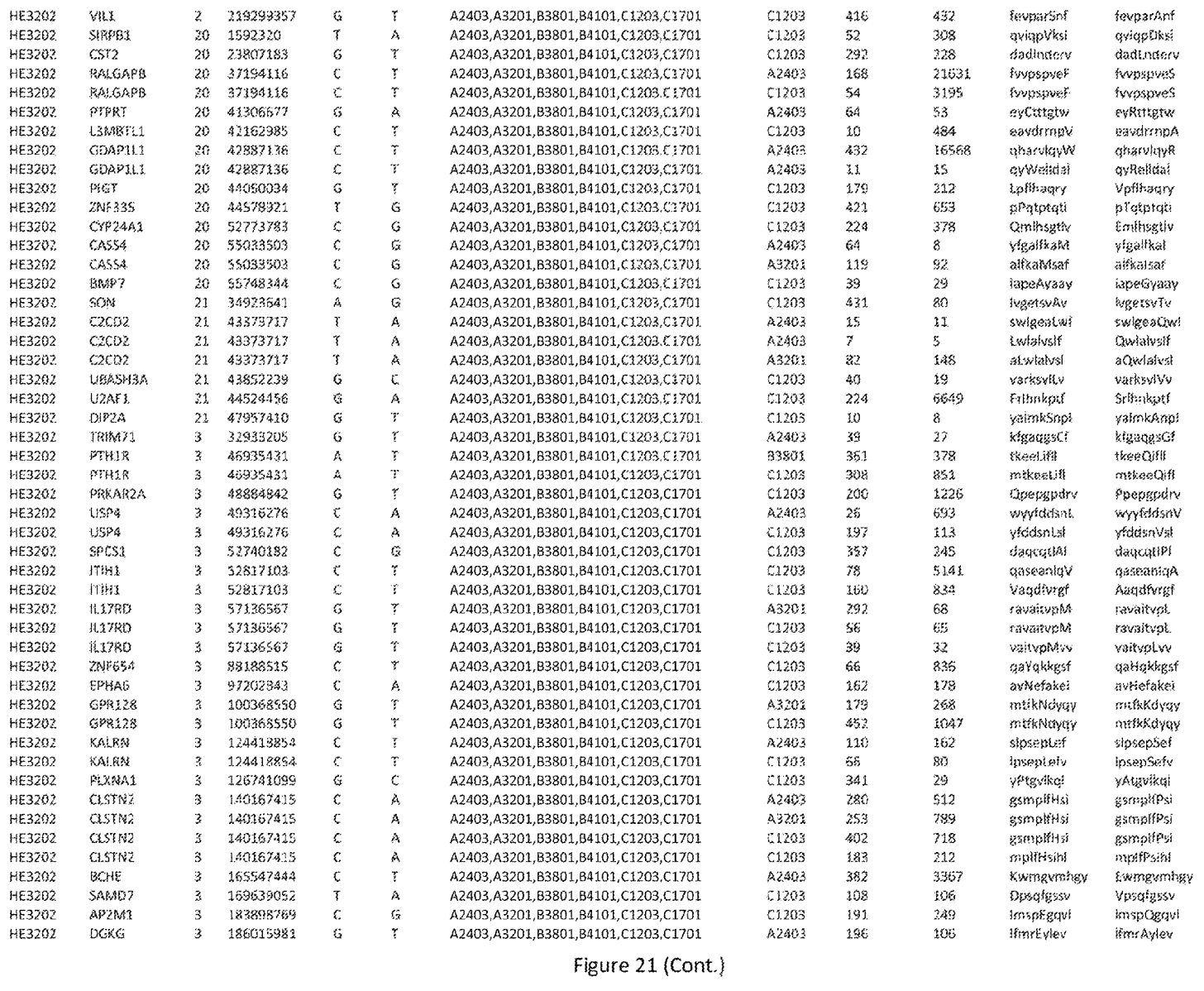
Figure 21:
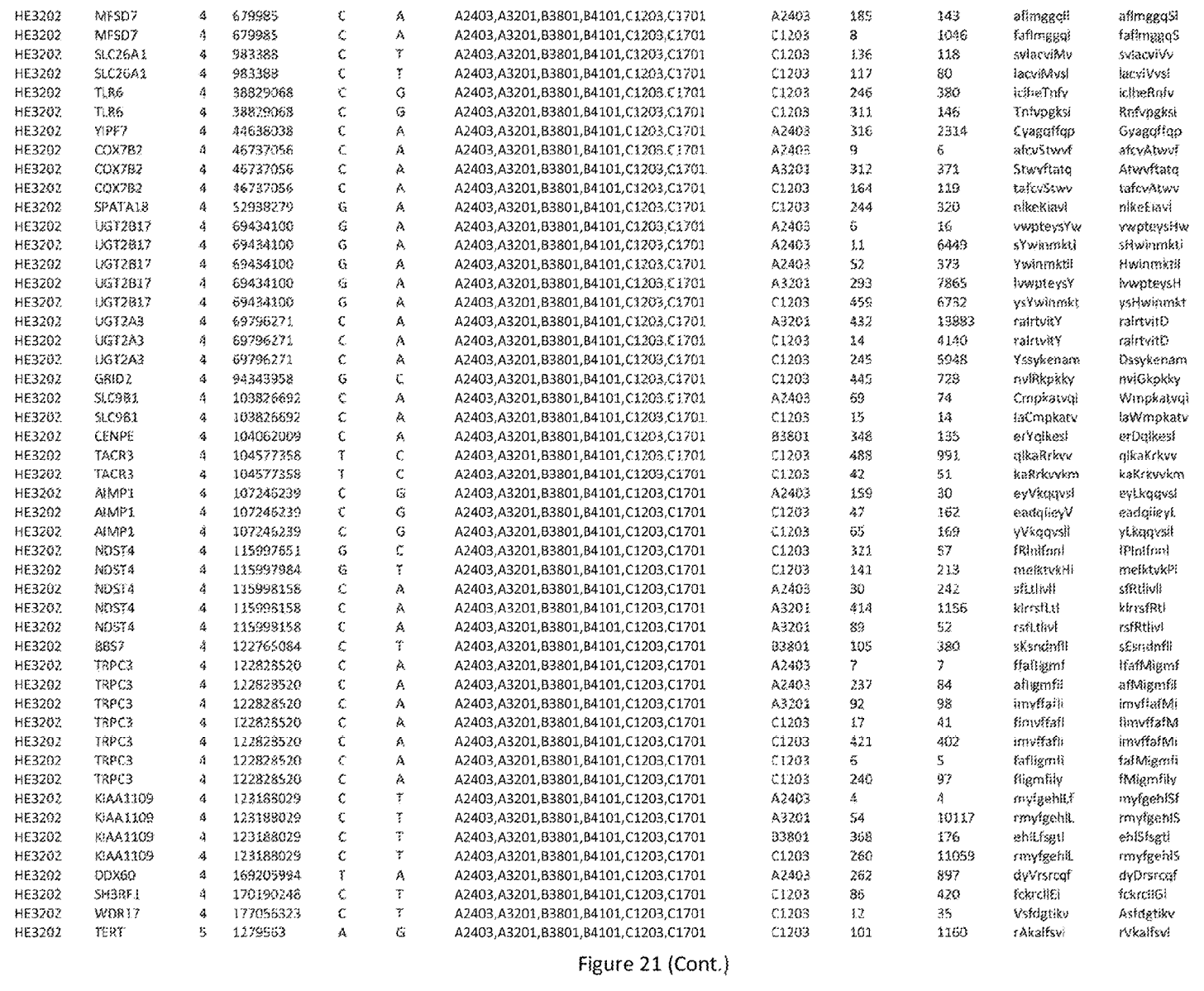
Figure 21:
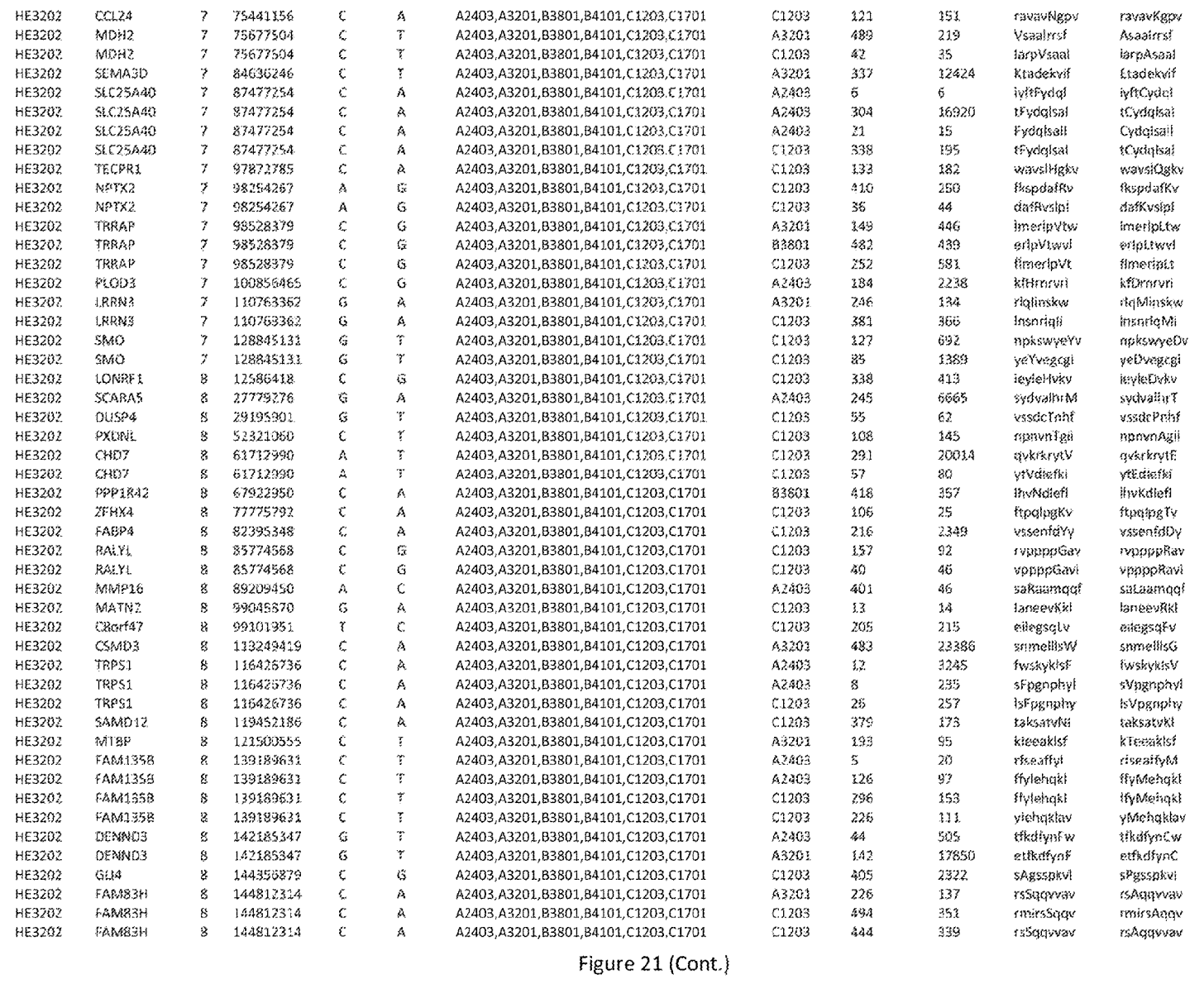
Figure 21:
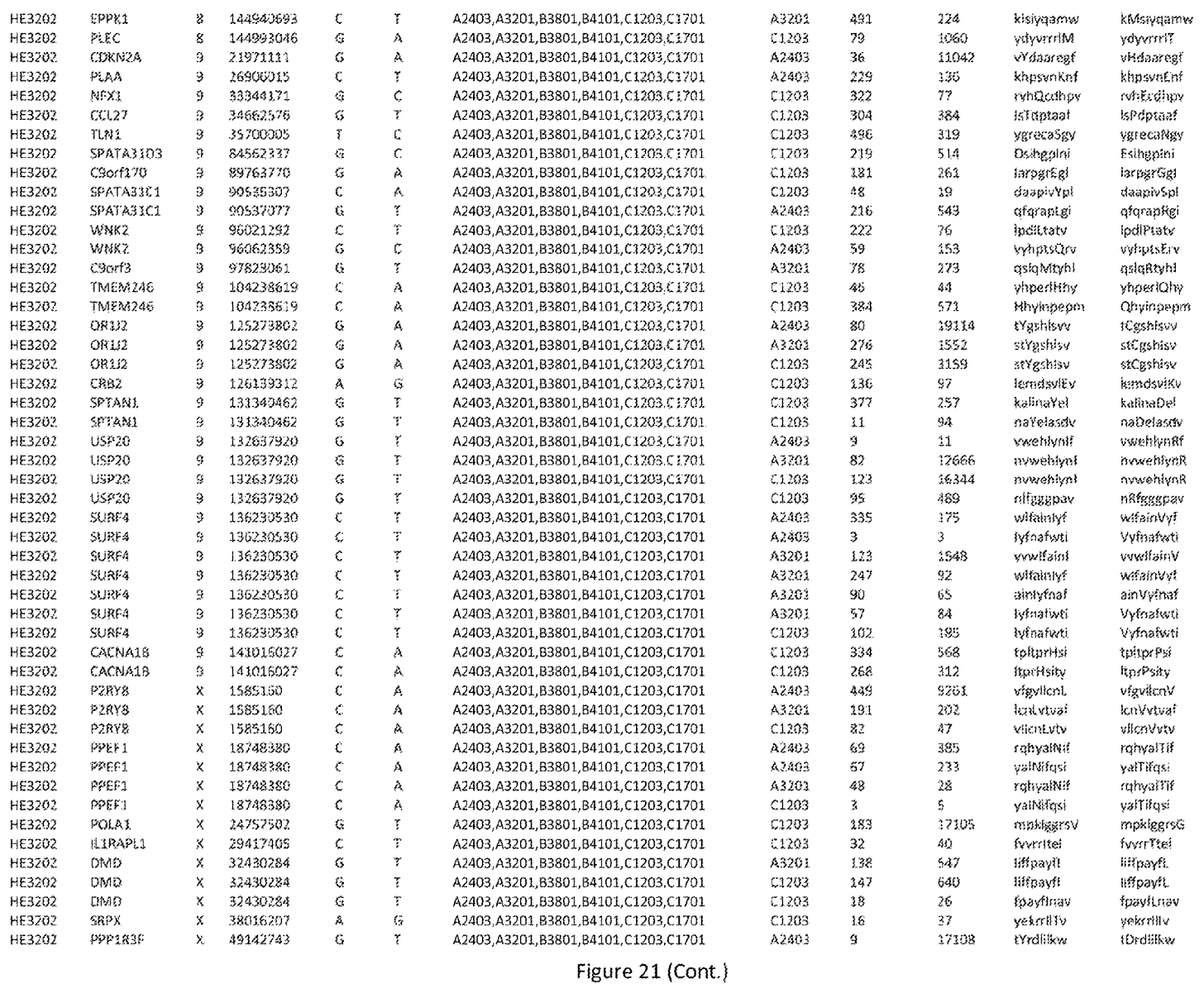
Figure 21:
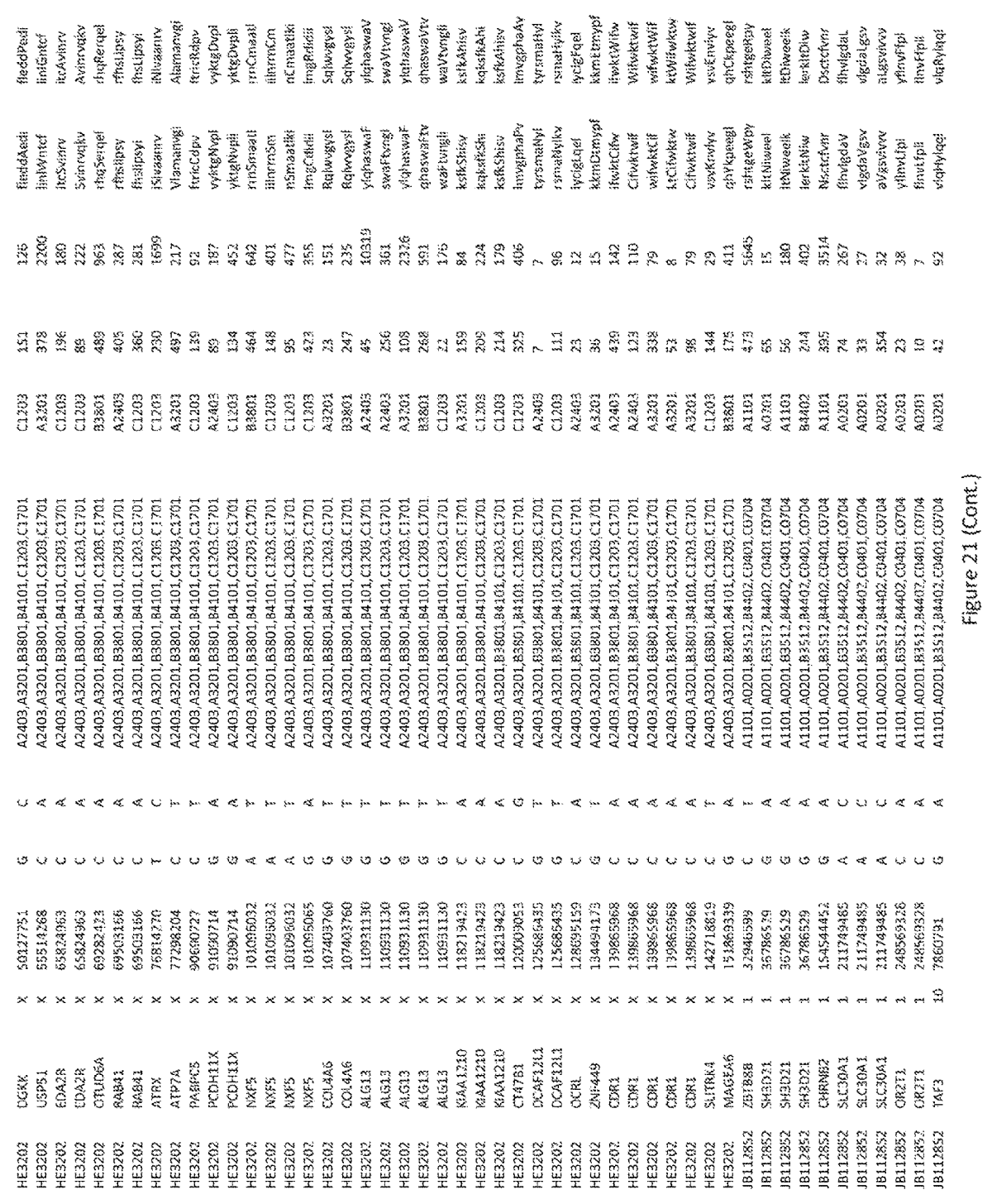
Figure 21:
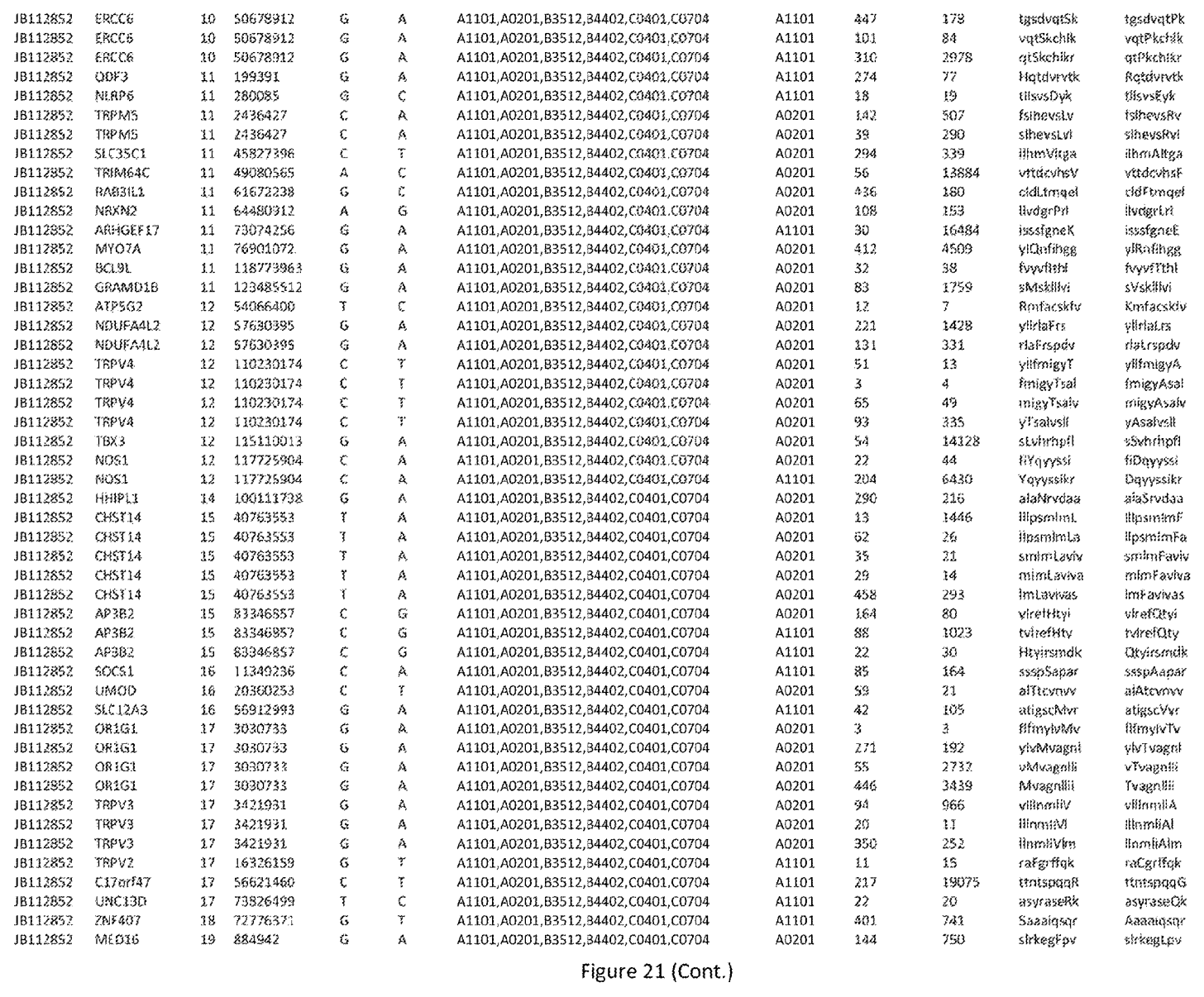
Figure 21:
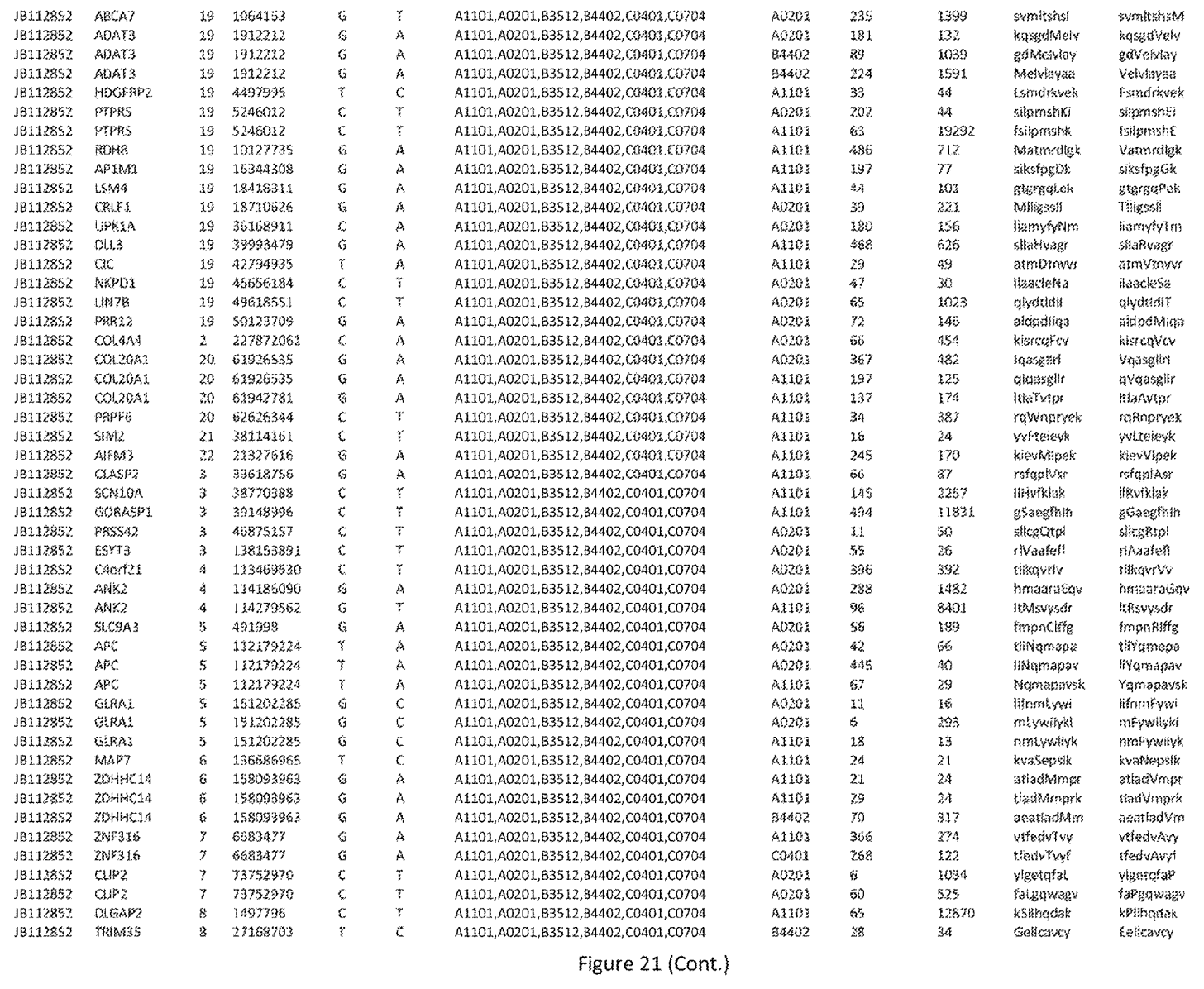
Figure 21:
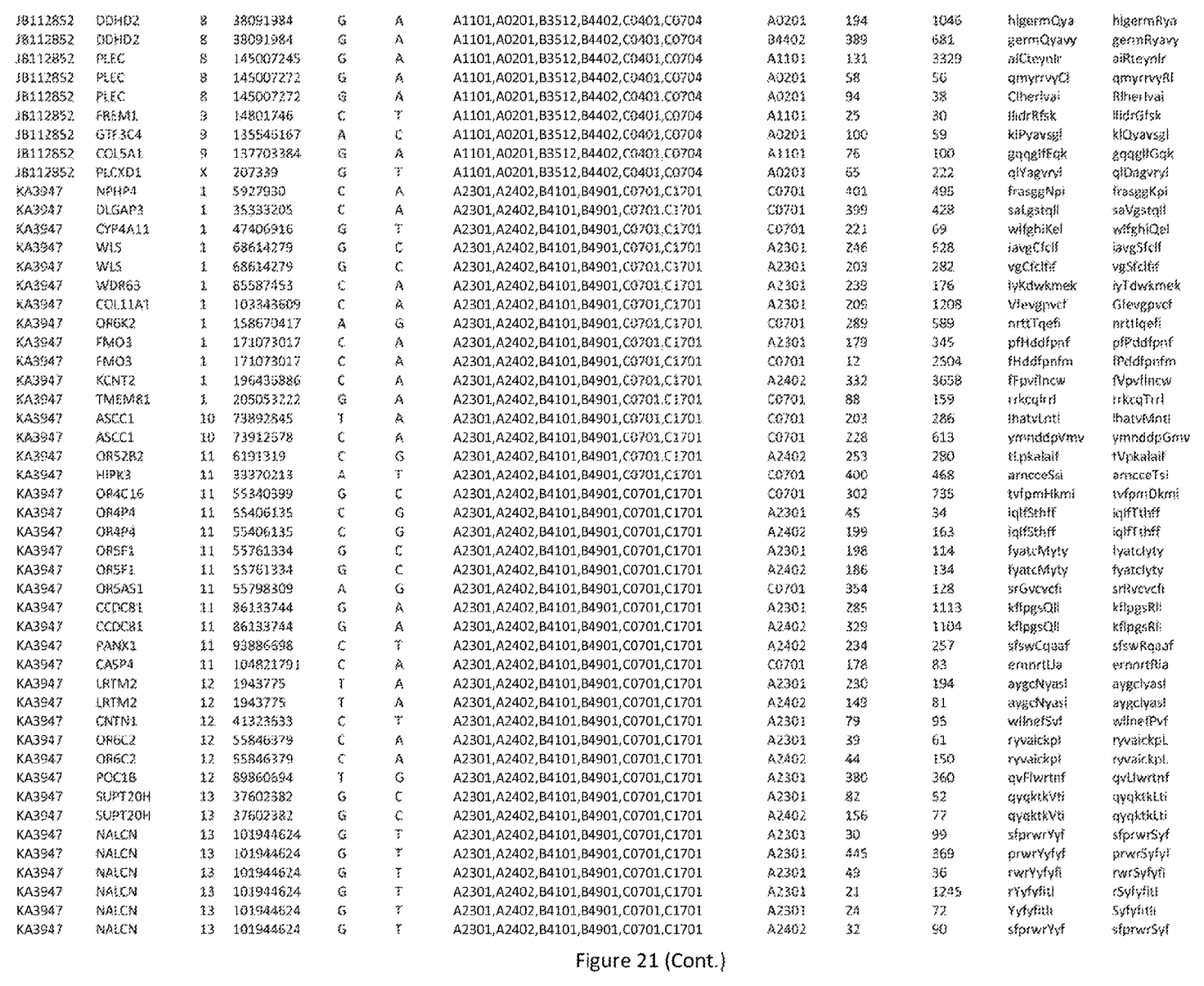
Figure 21:
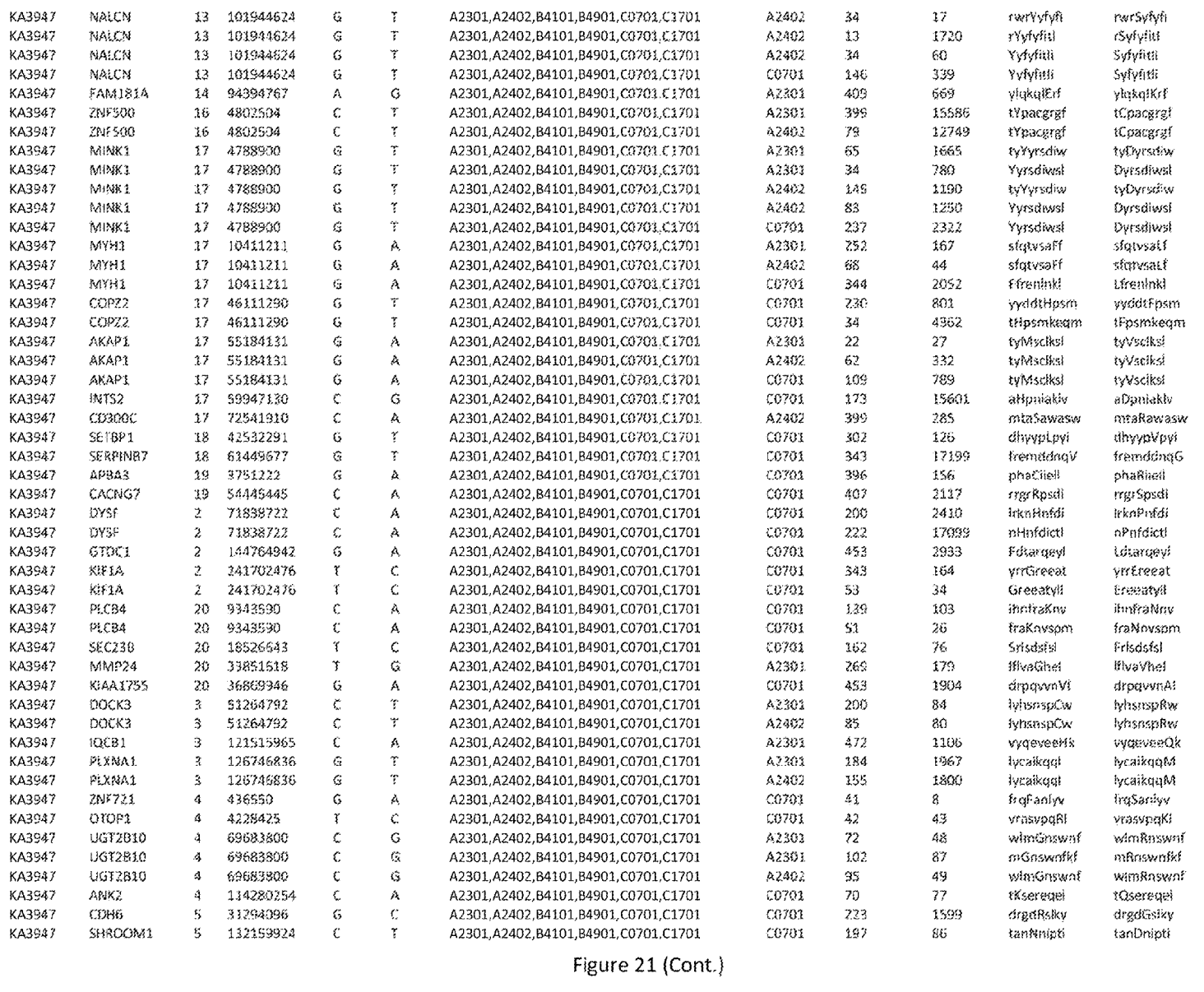
Figure 21:
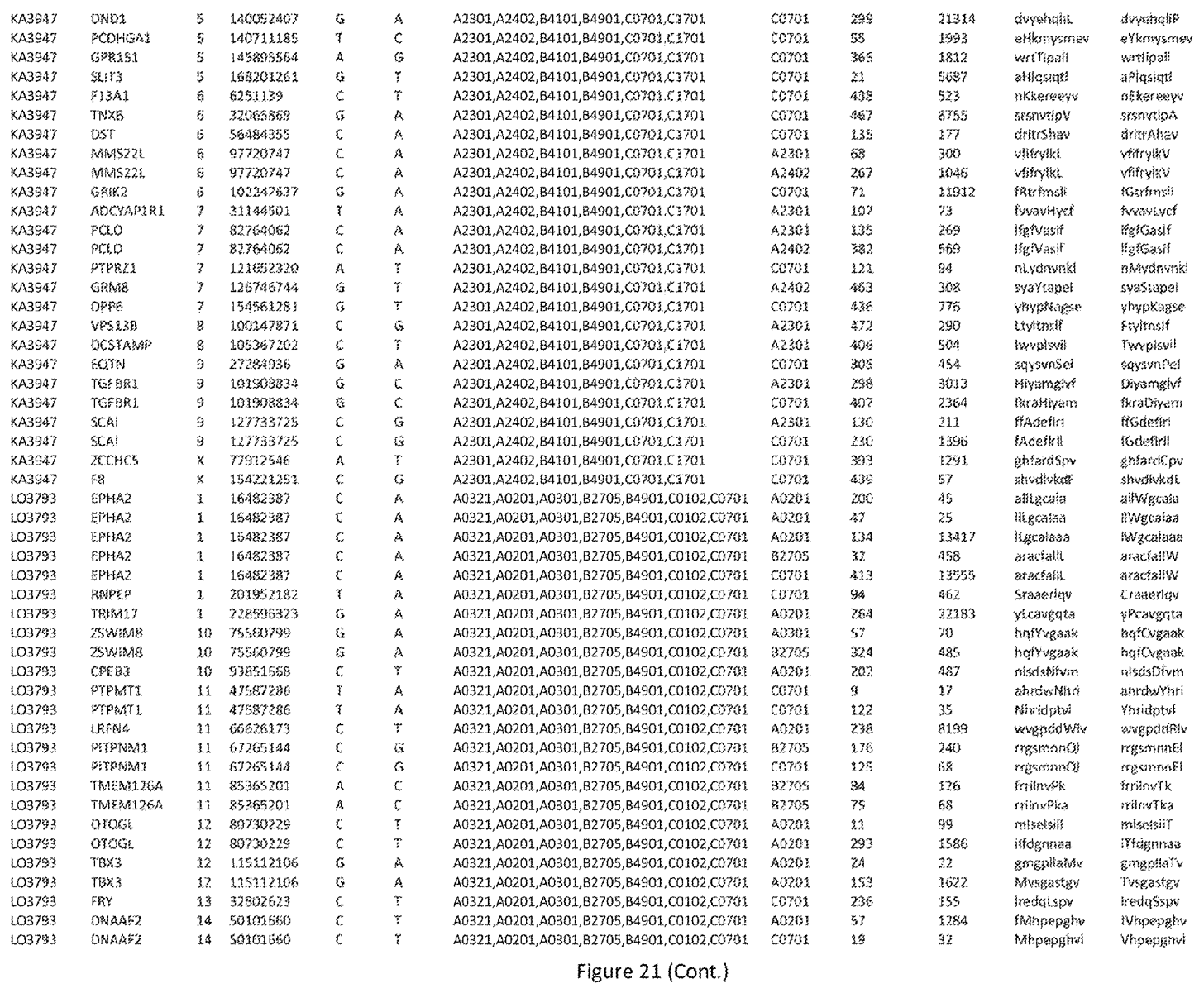
Figure 21:
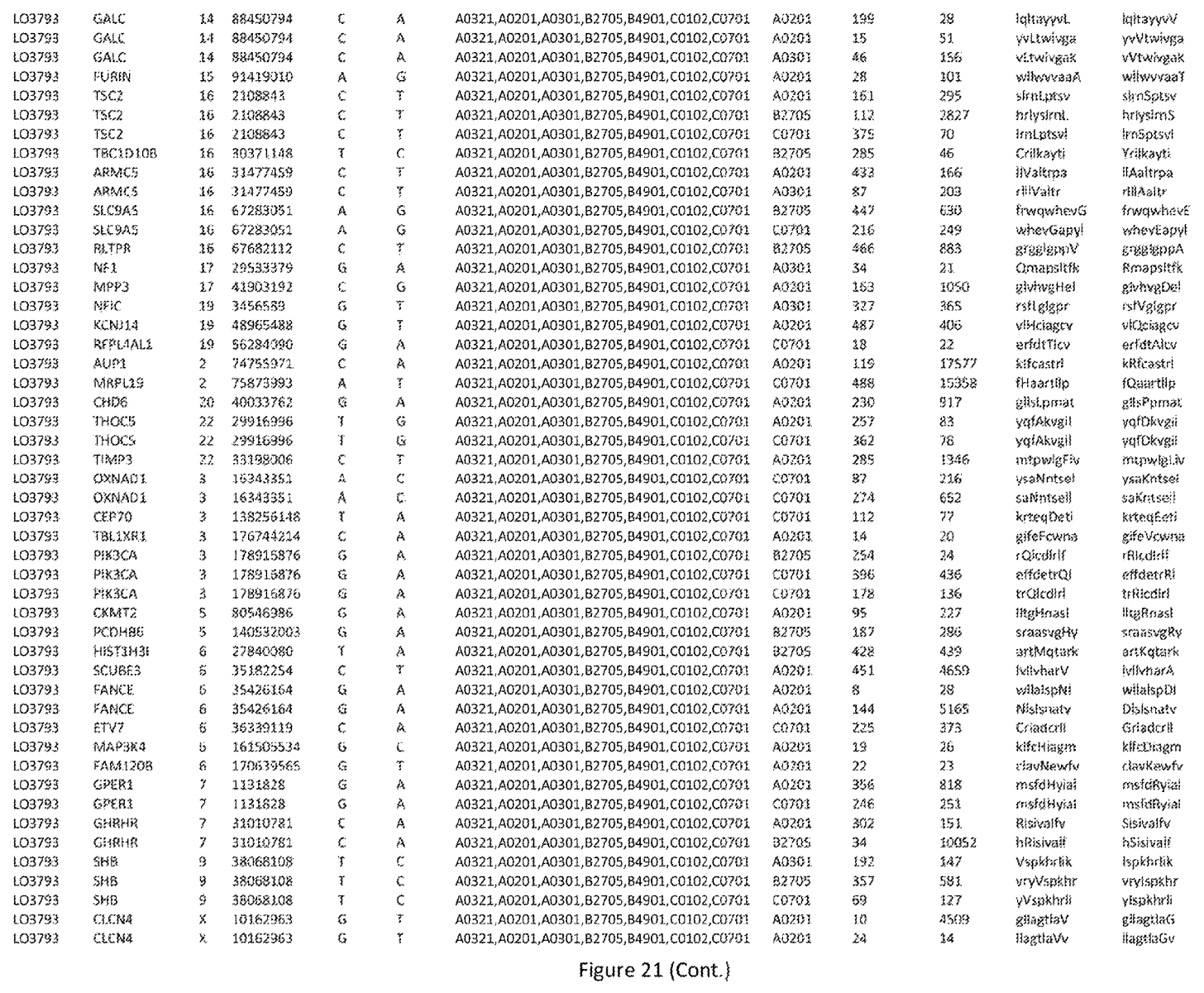
Figure 21:
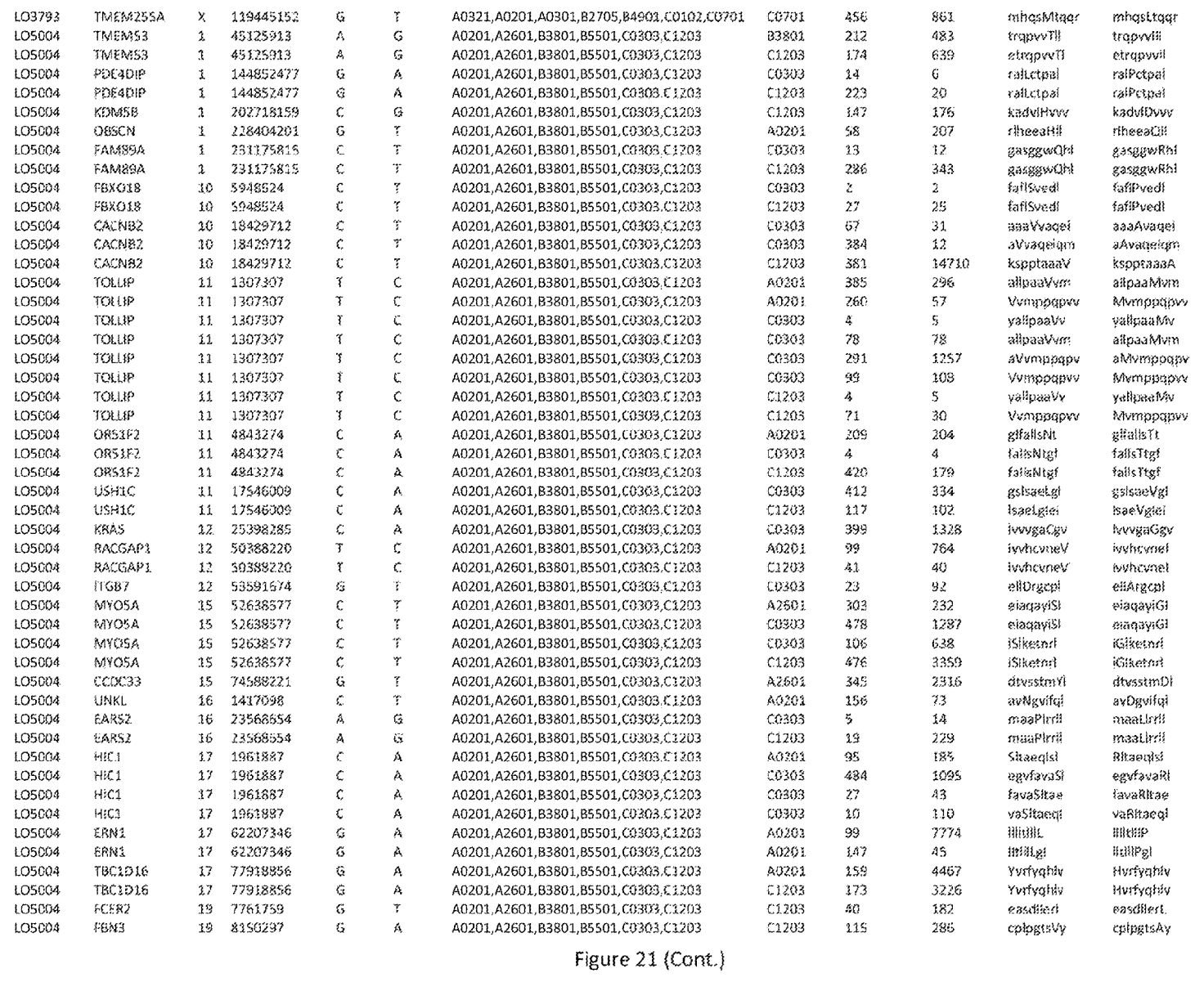
Figure 21:
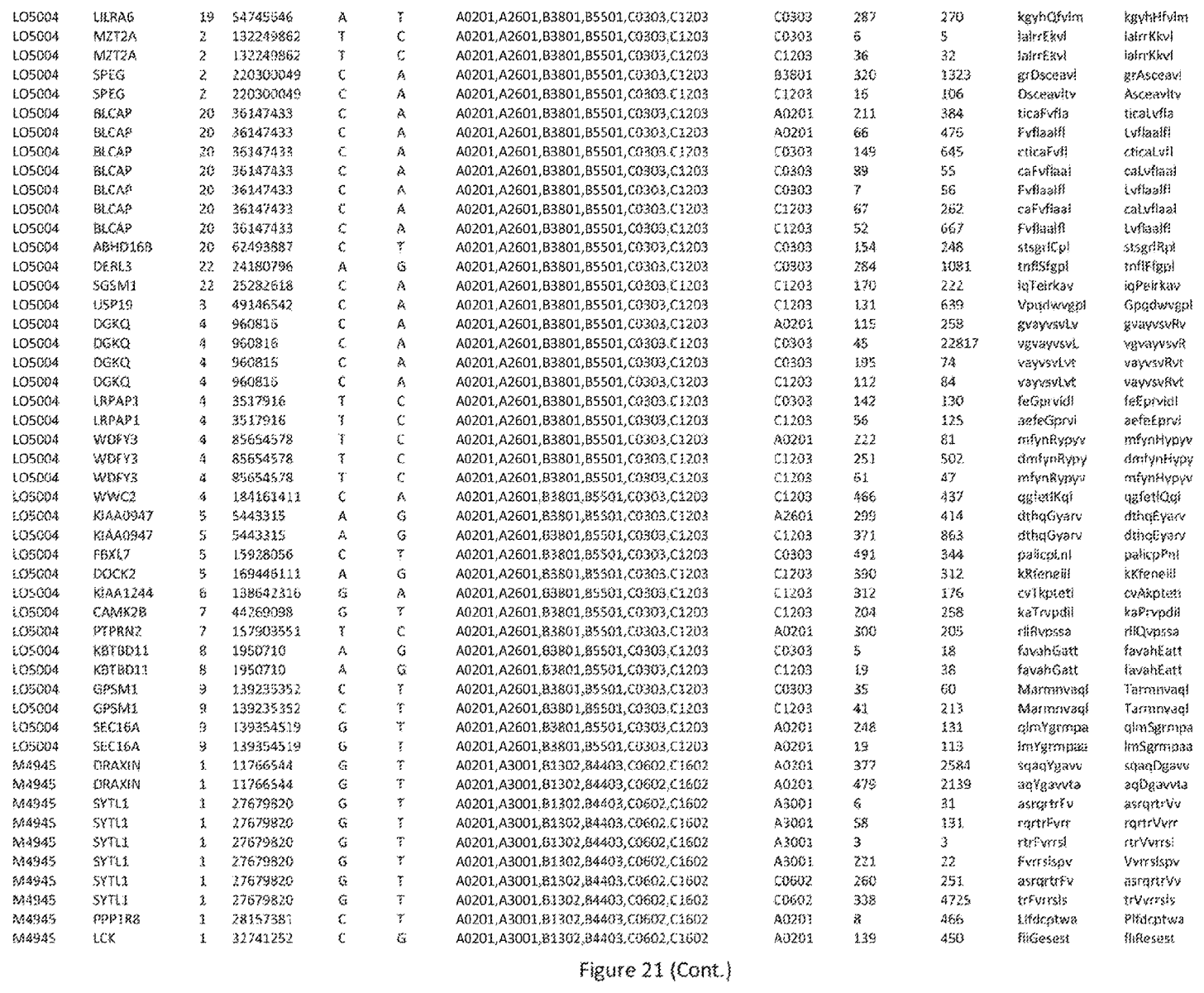
Figure 21:
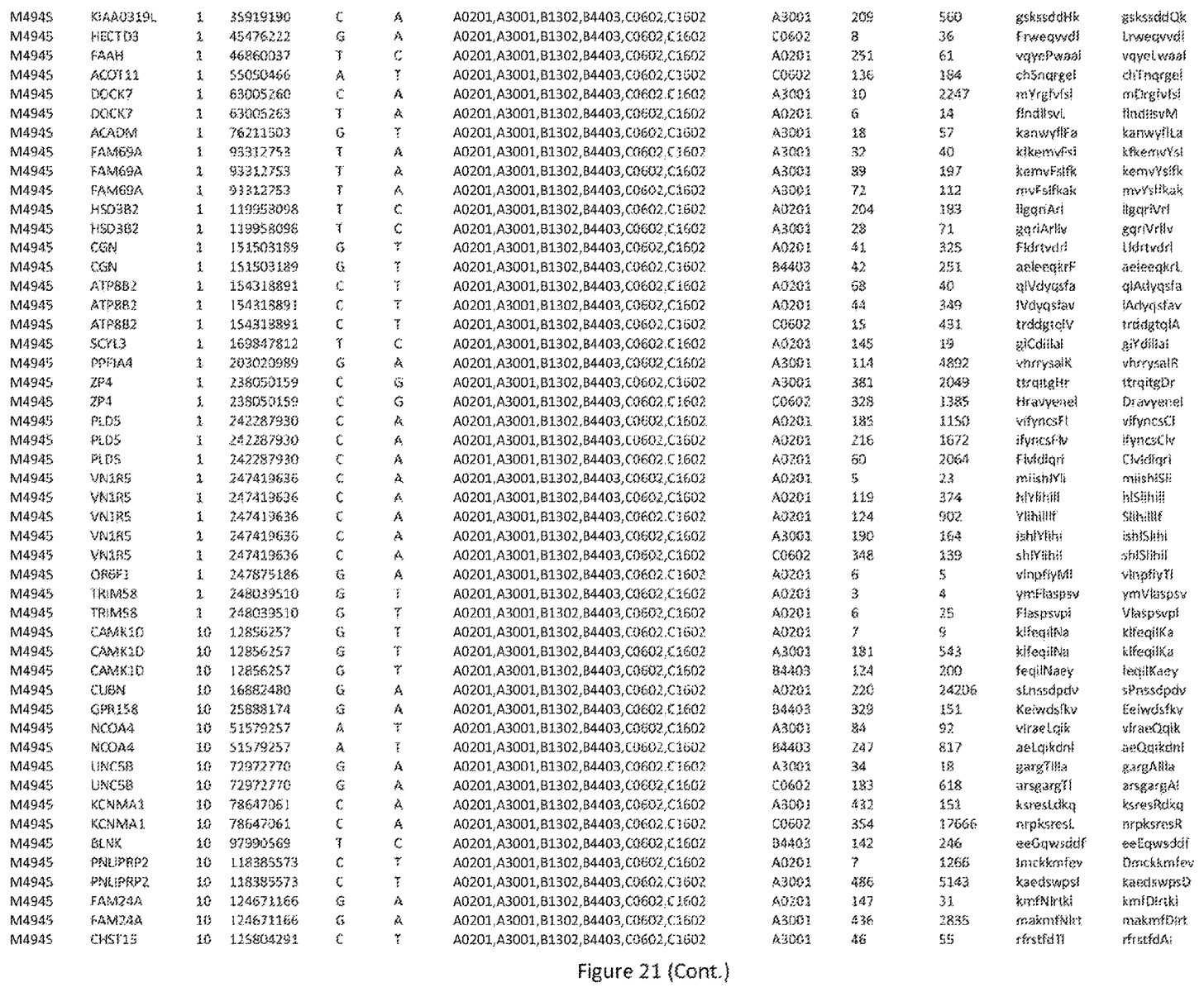
Figure 21:
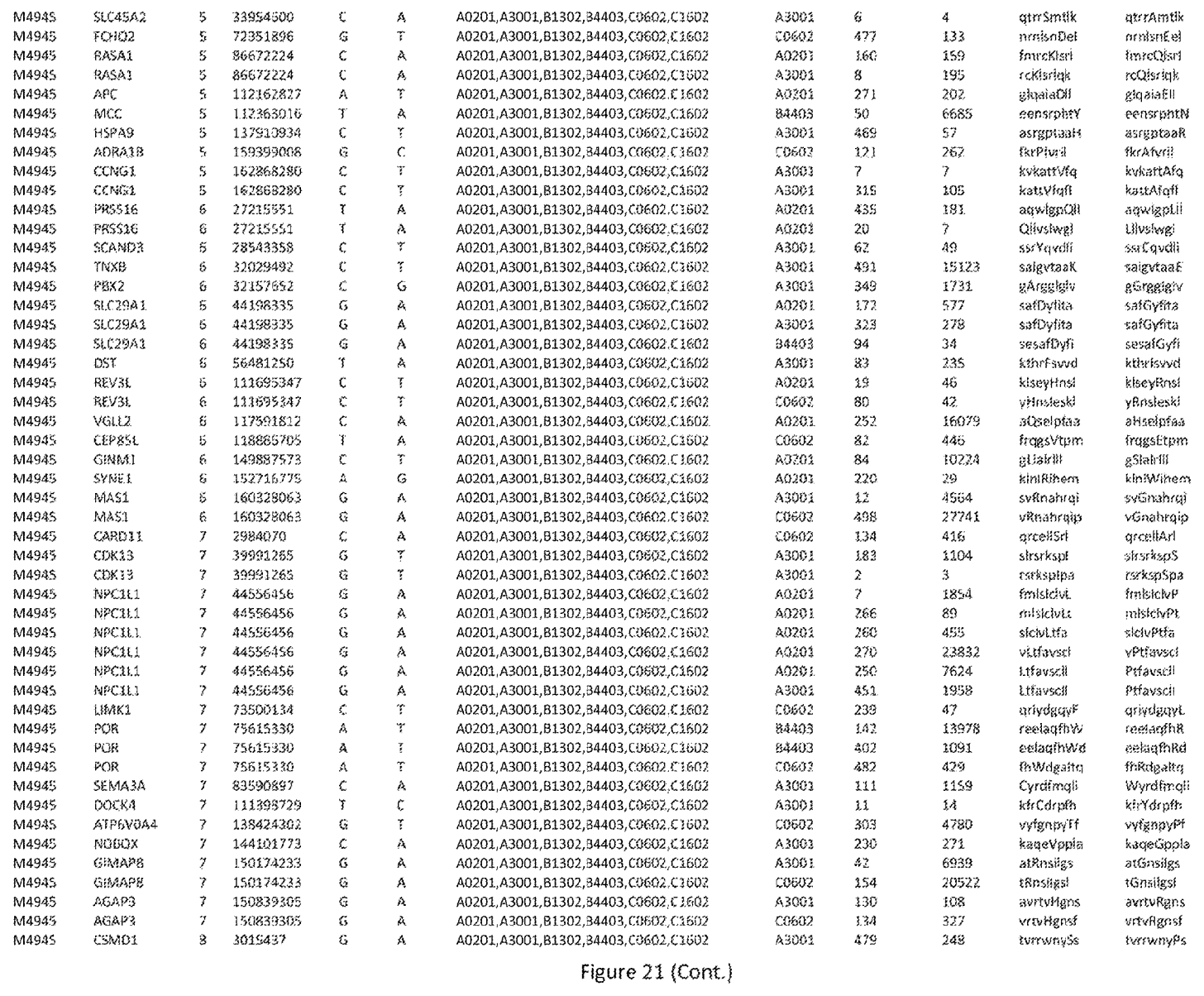
Figure 21:
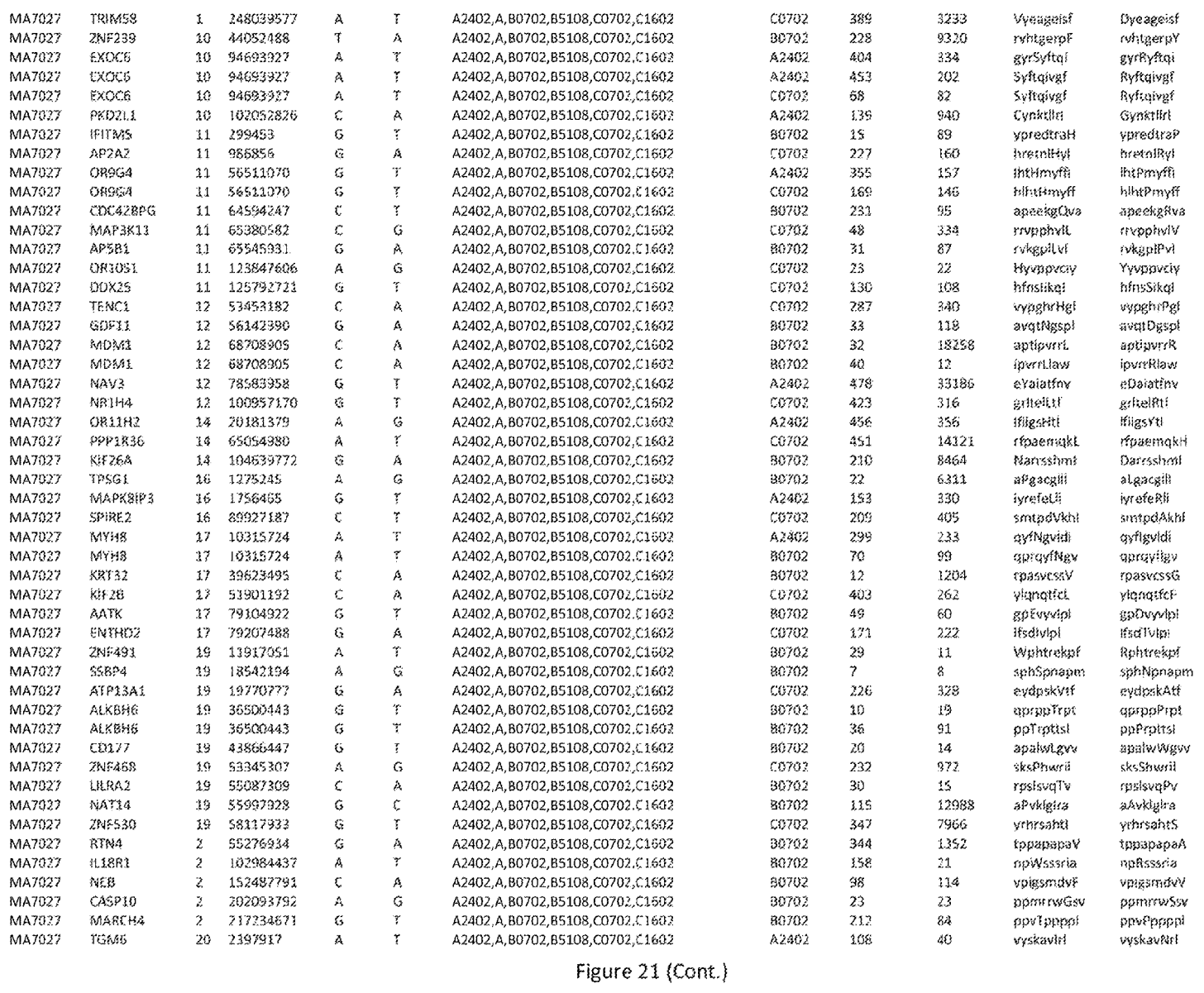
Figure 21:
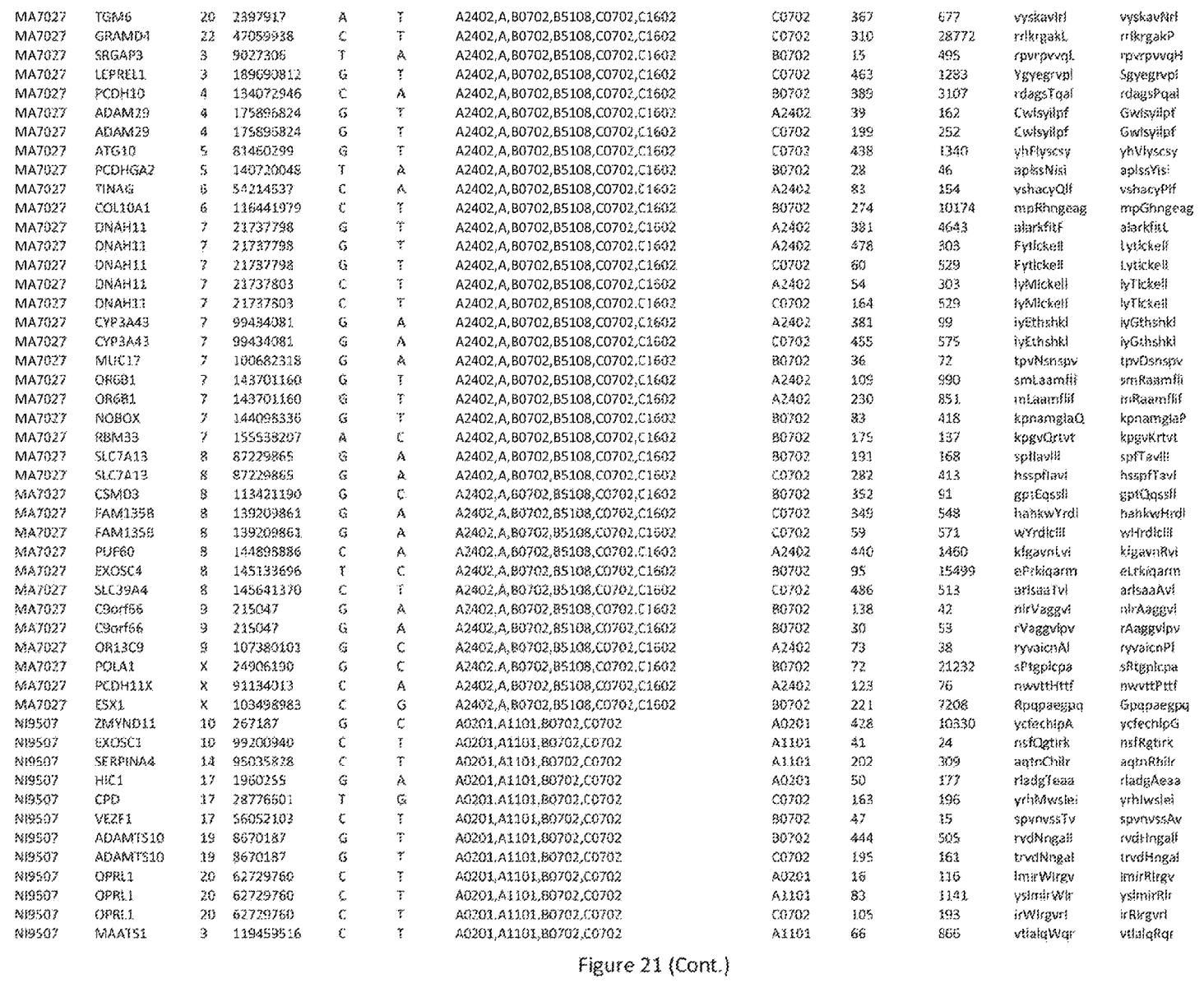
Figure 21:
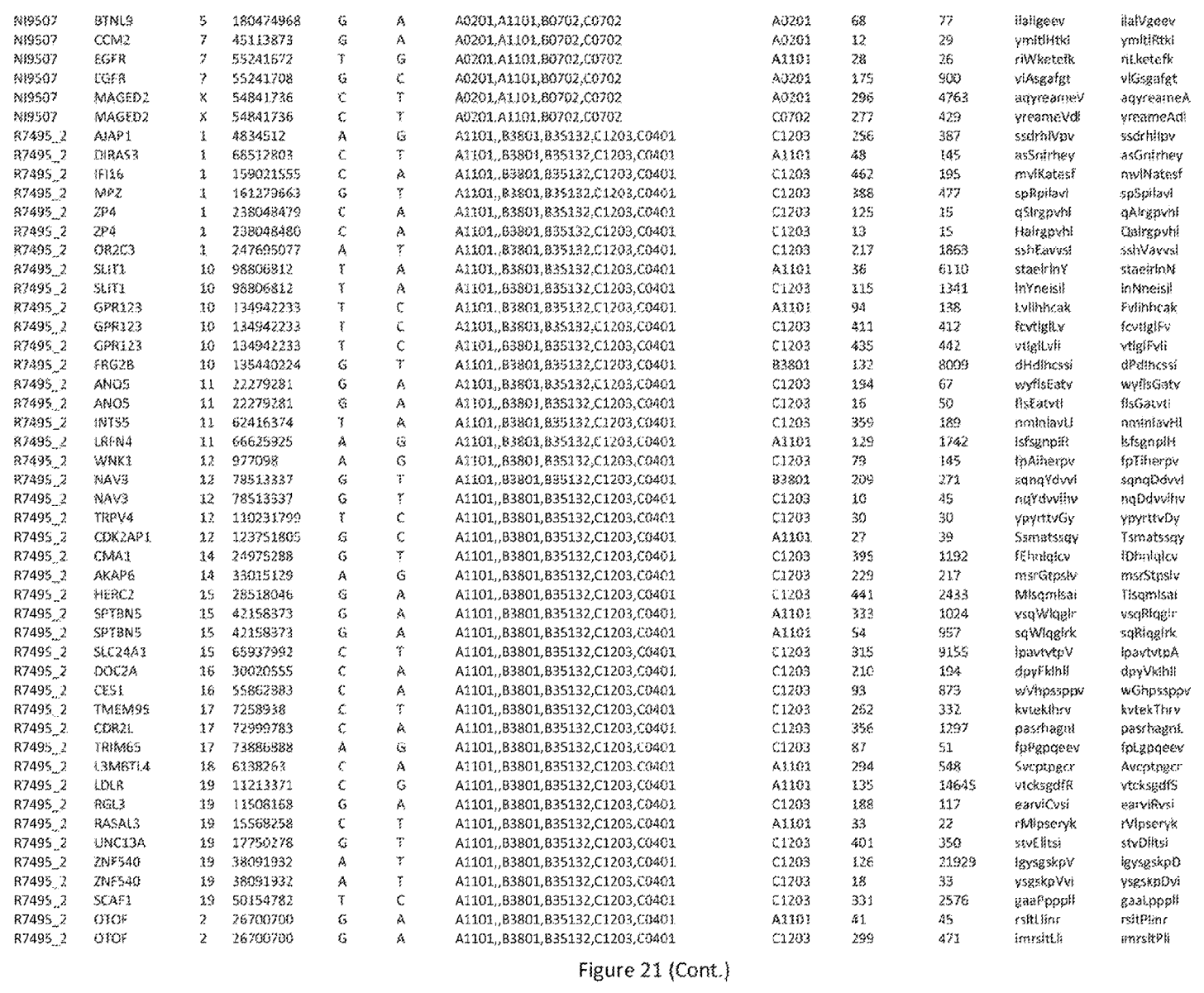
Figure 21:
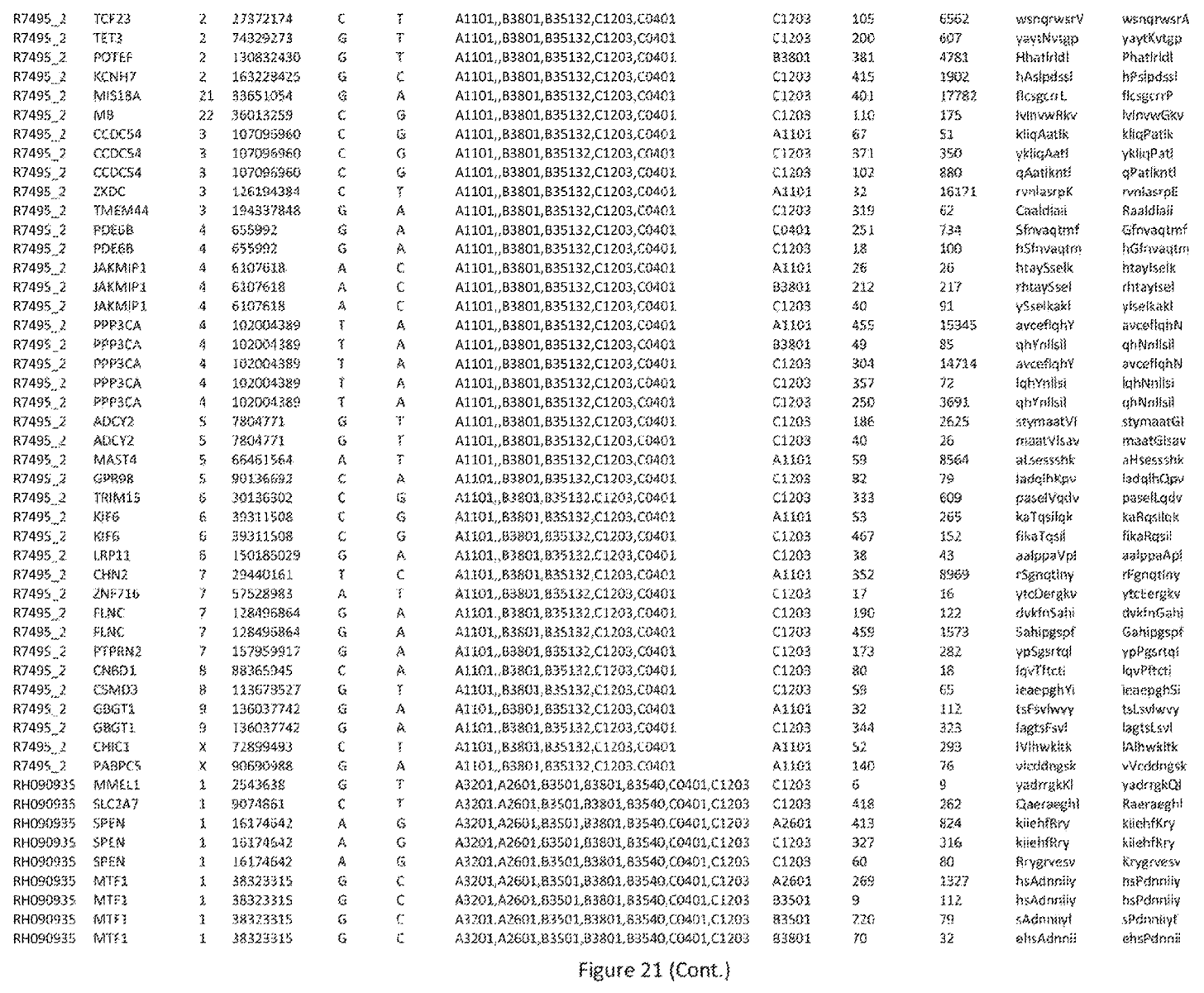
Figure 21:
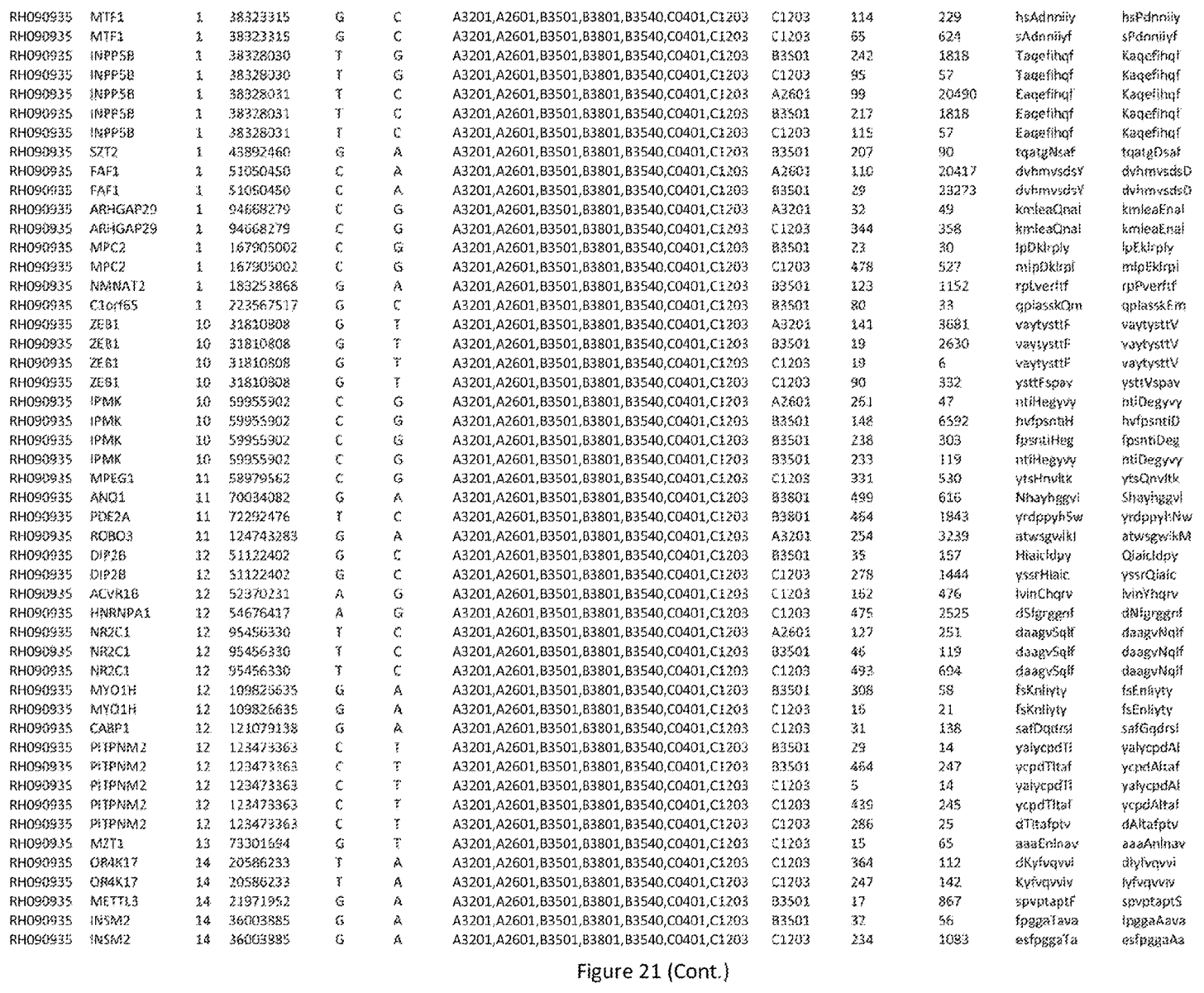
Figure 21:
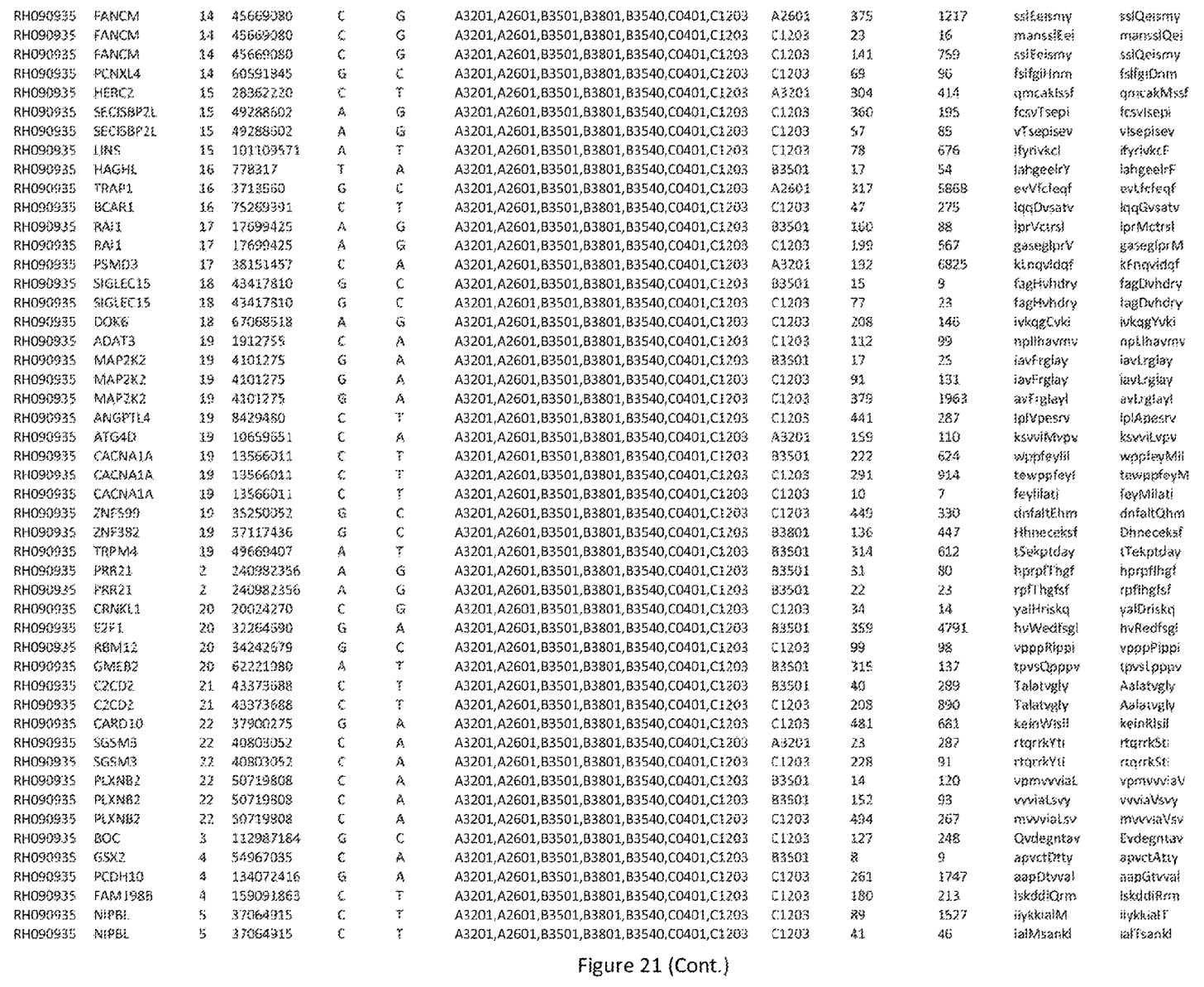
Figure 21:
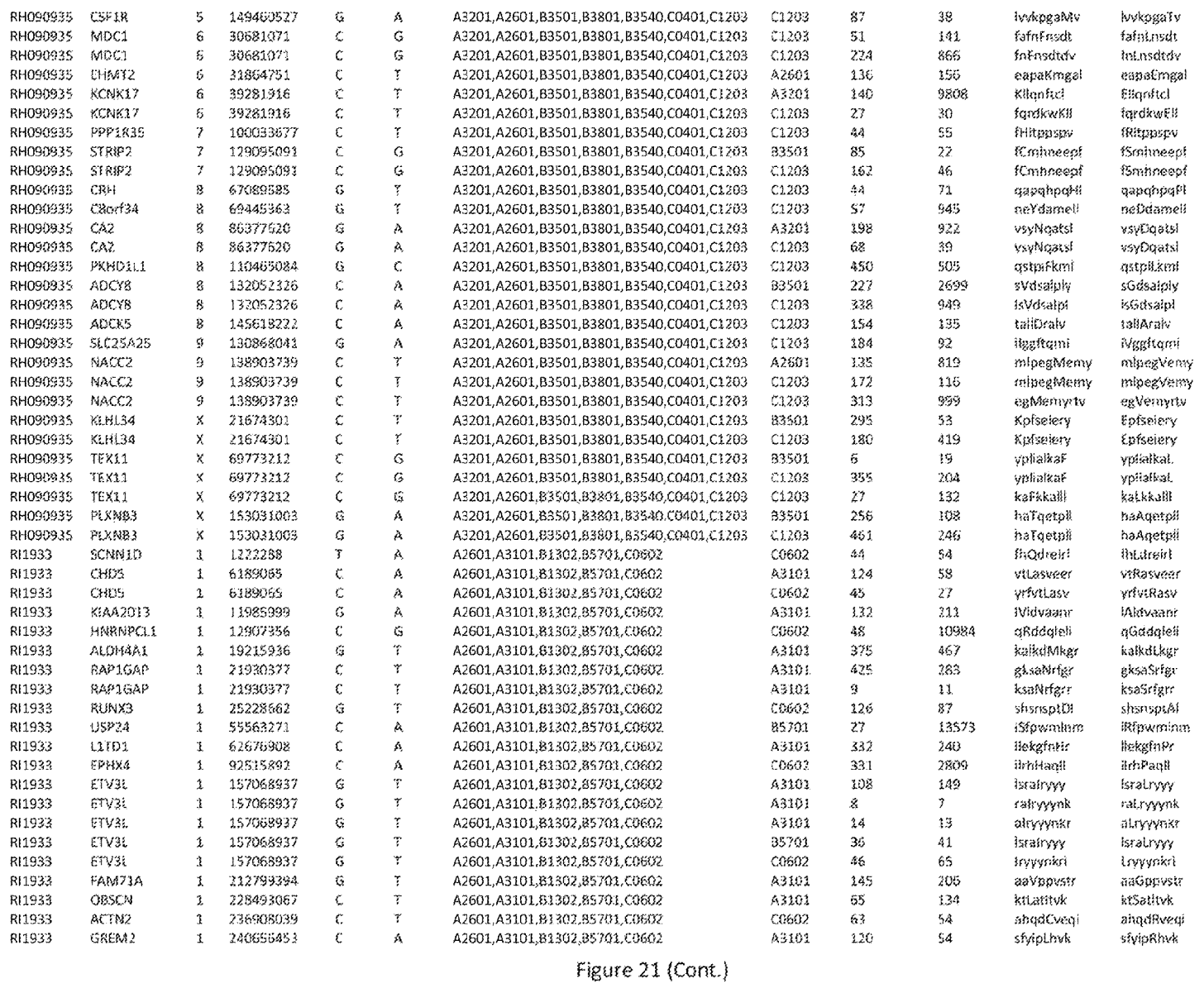
Figure 21:
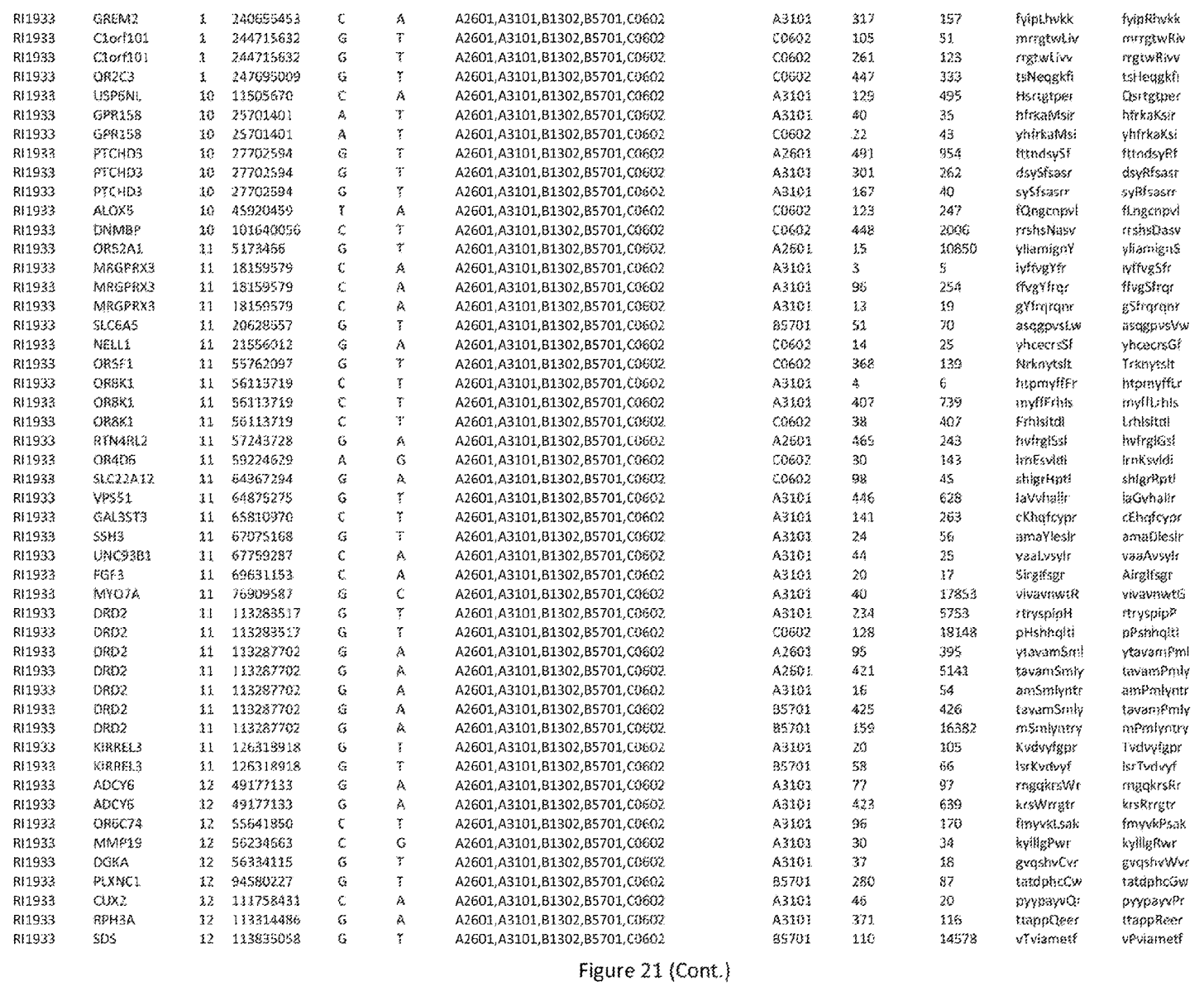
Figure 21:
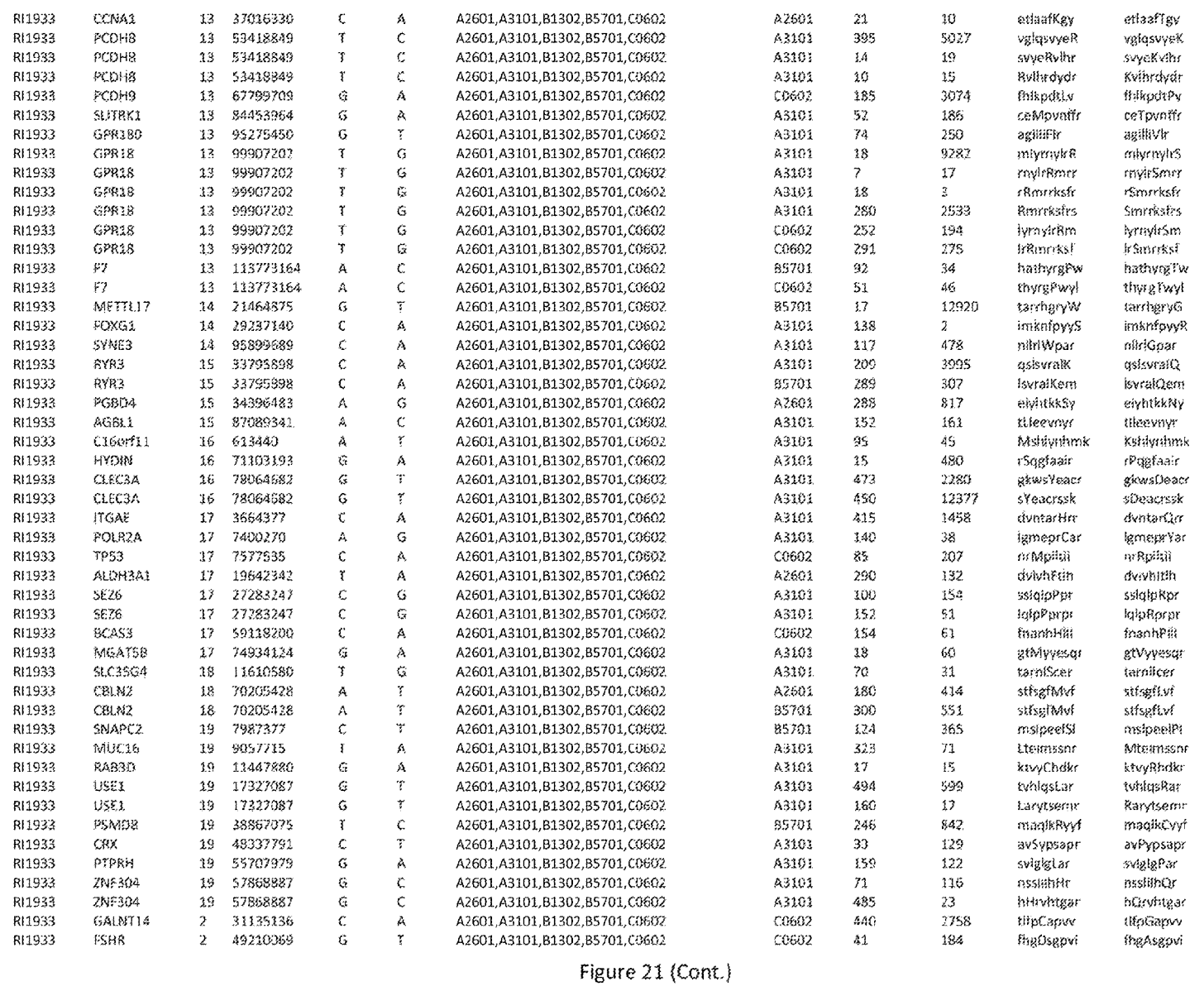
Figure 21:
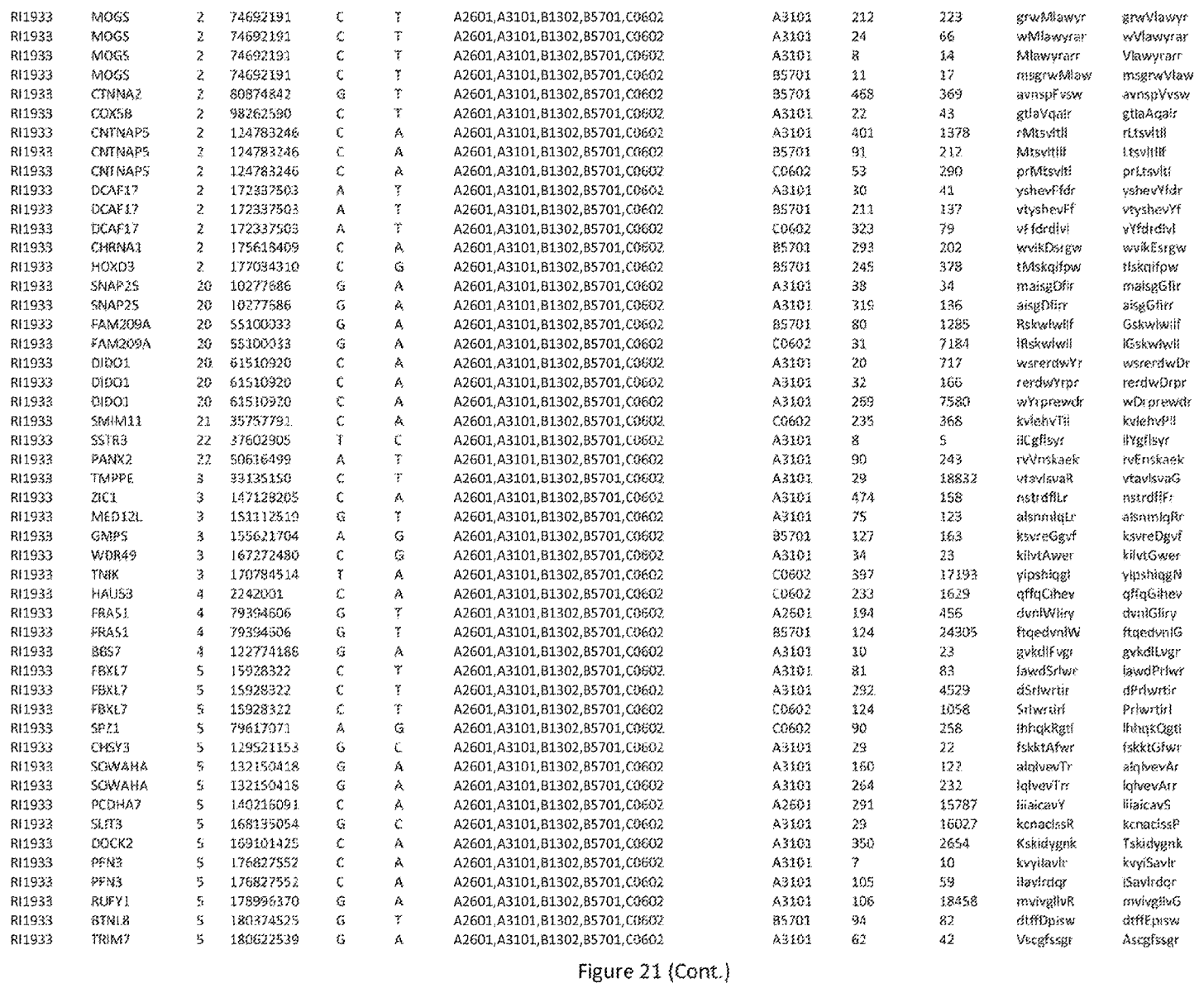
Figure 21:
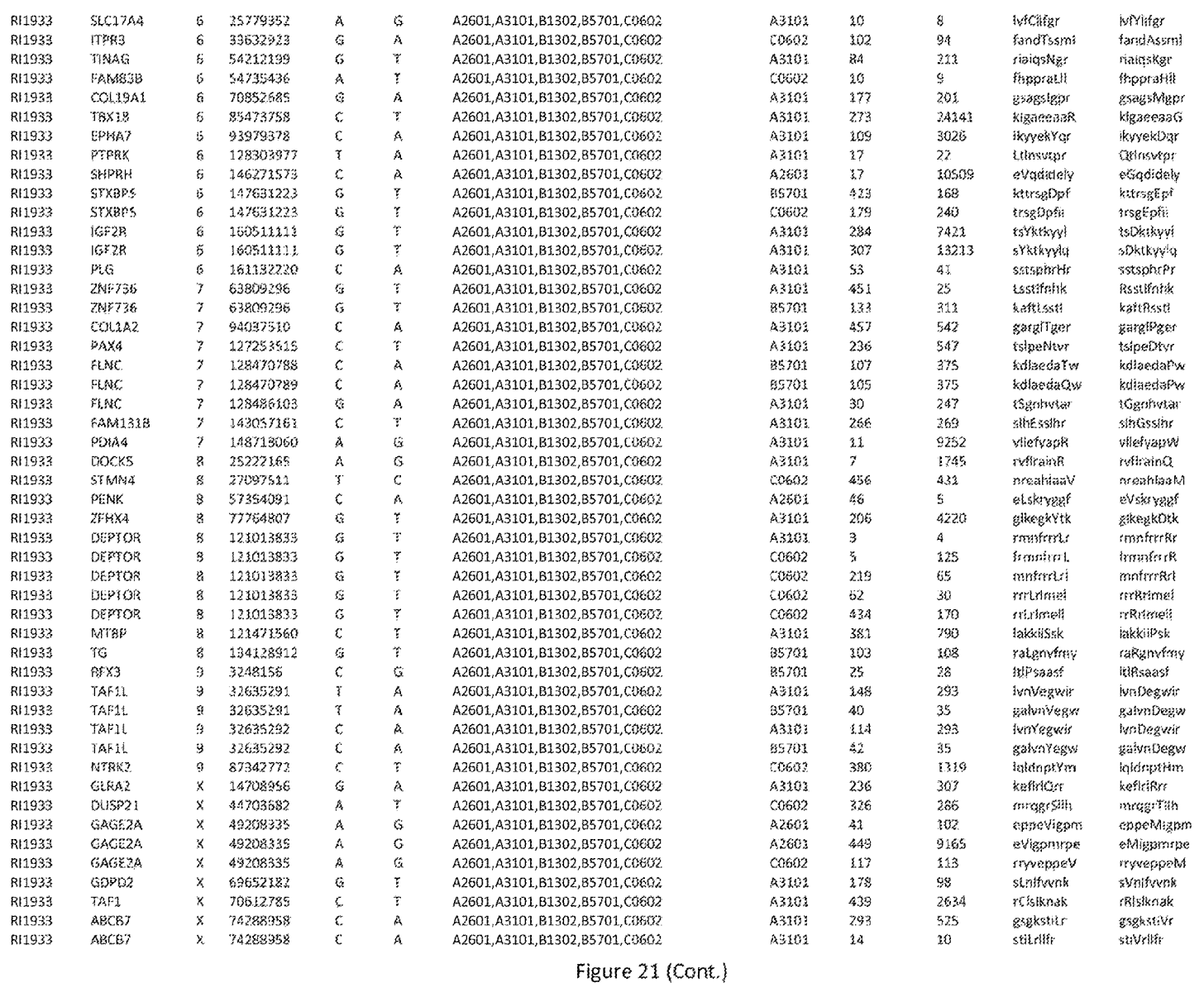
Figure 21:
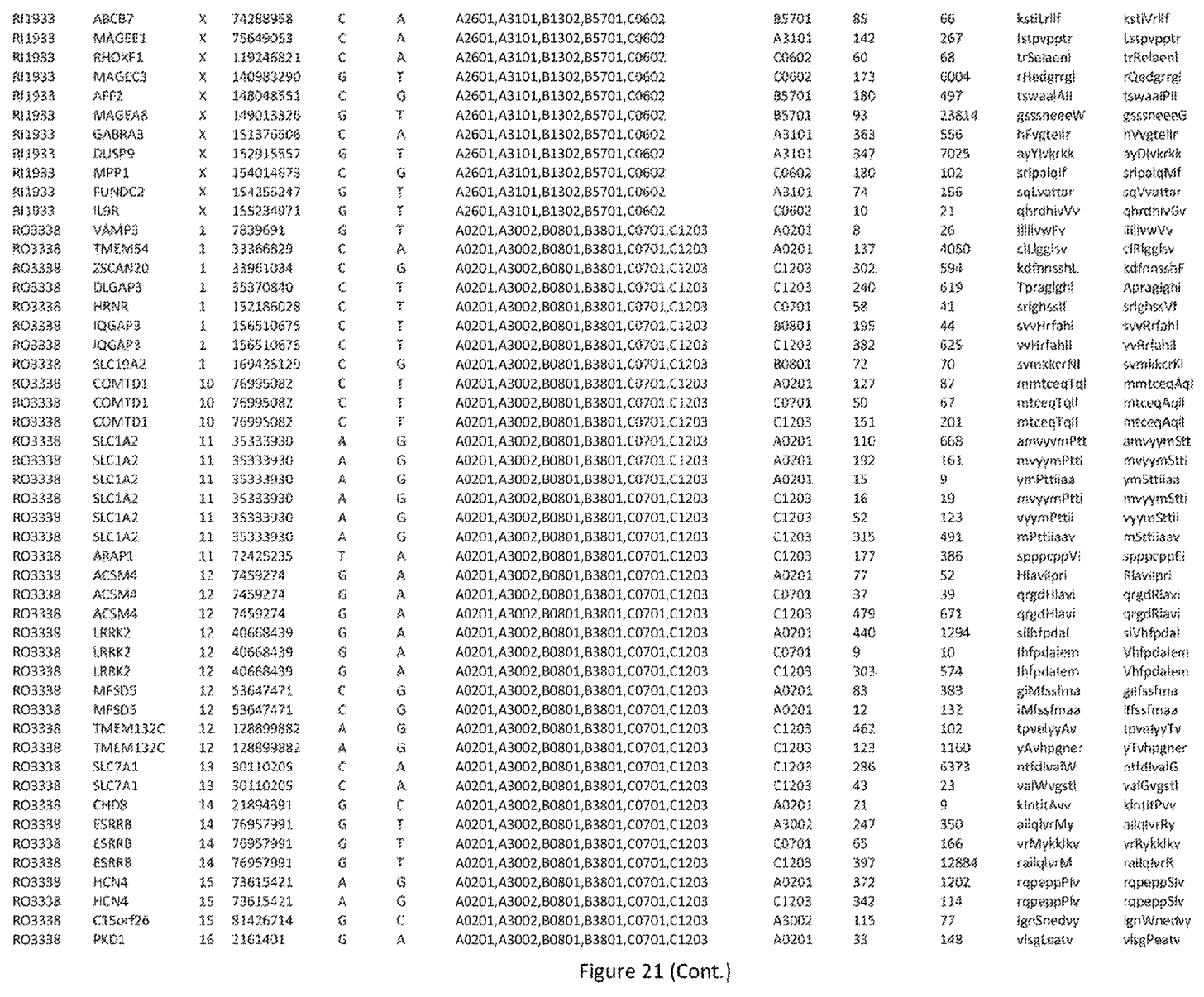
Figure 21:
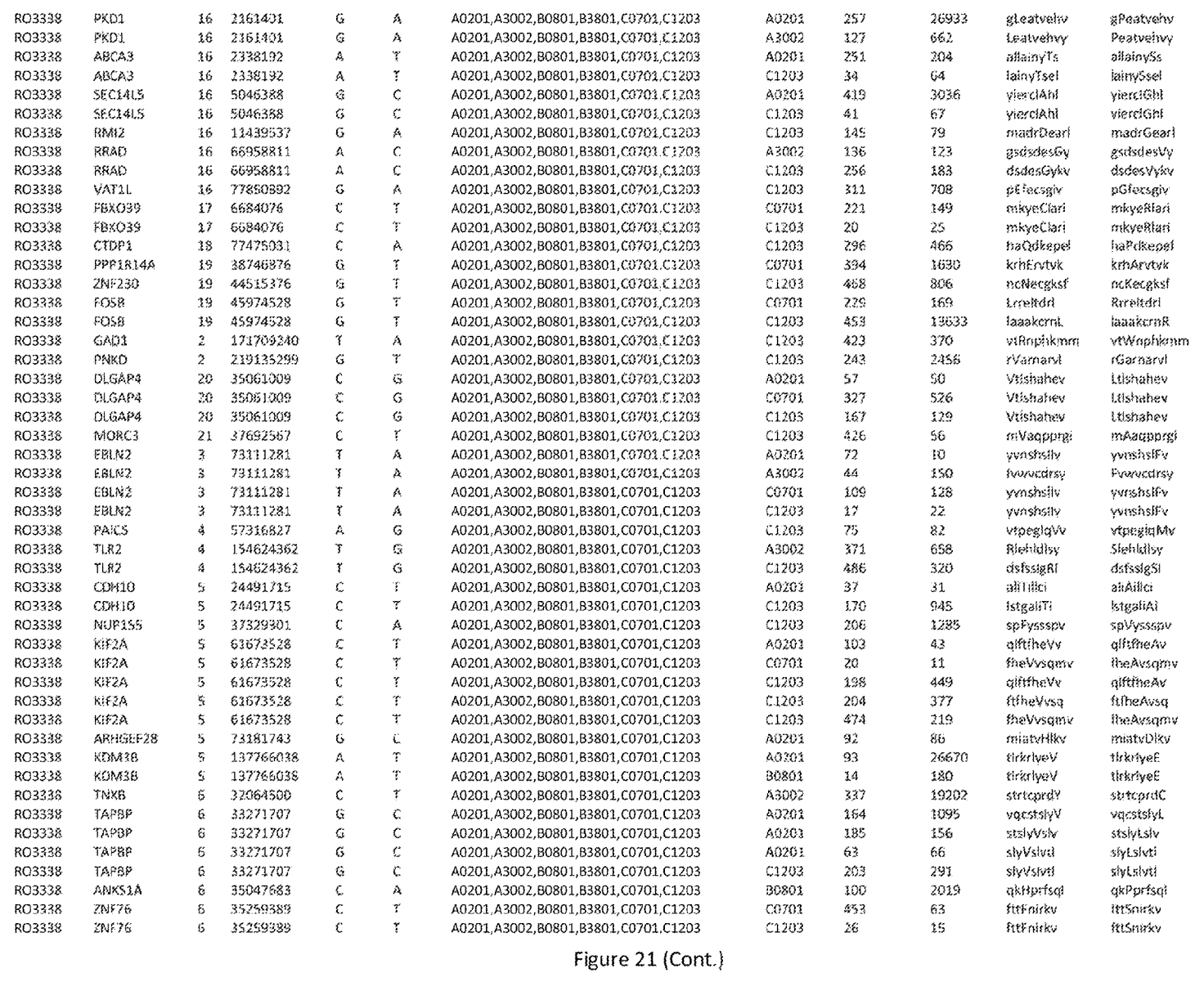
Figure 21:
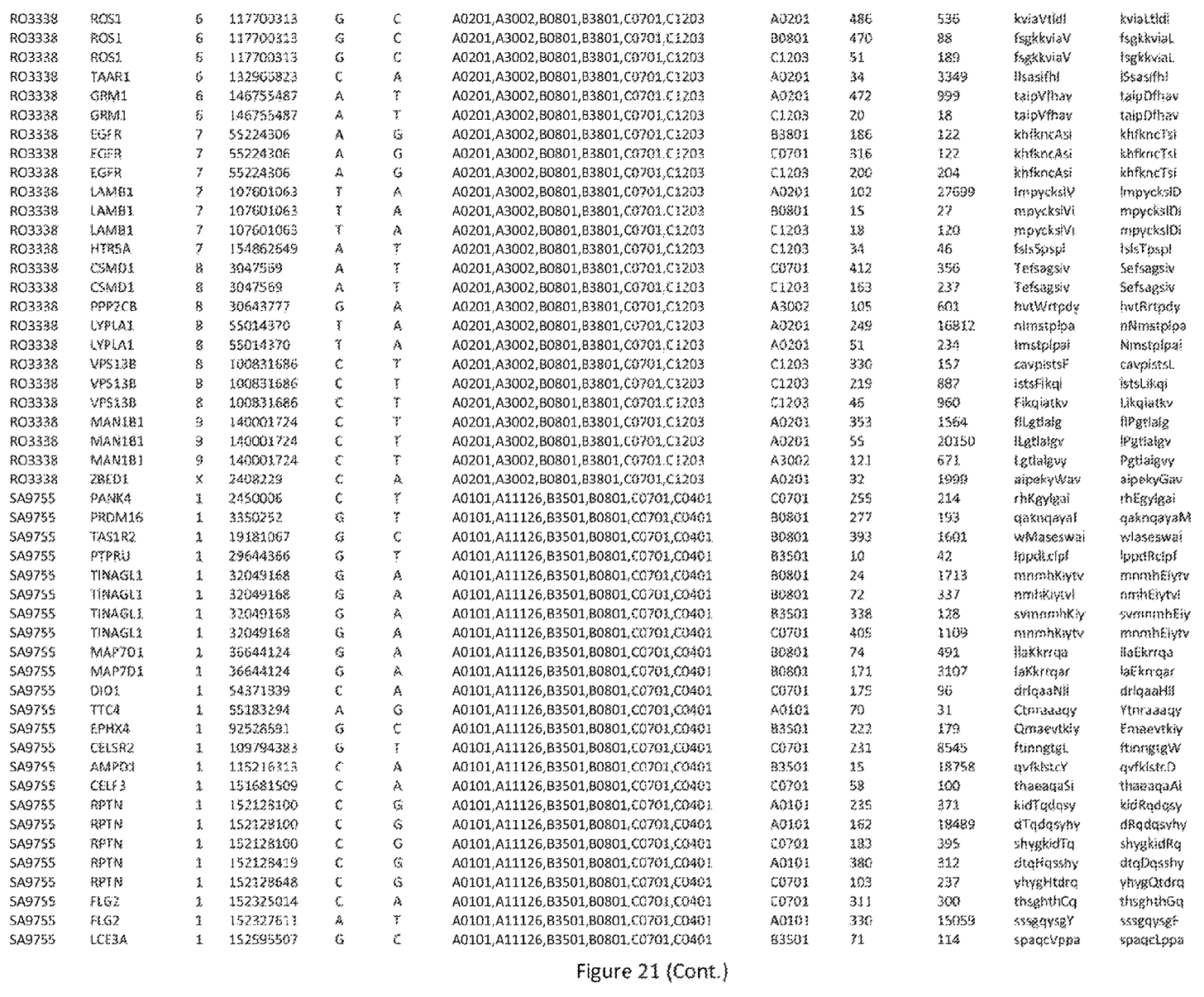
Figure 21:
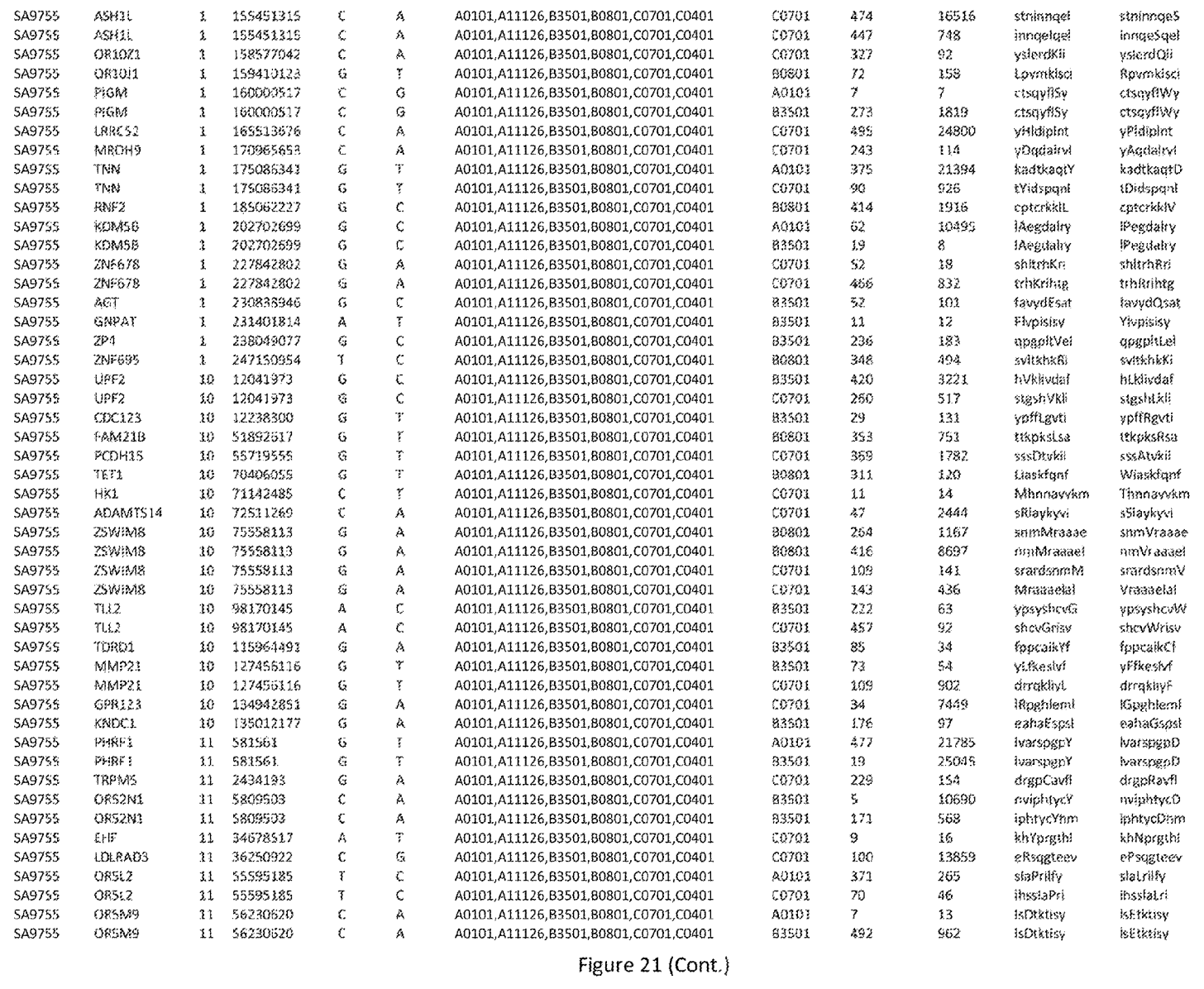
Figure 21:
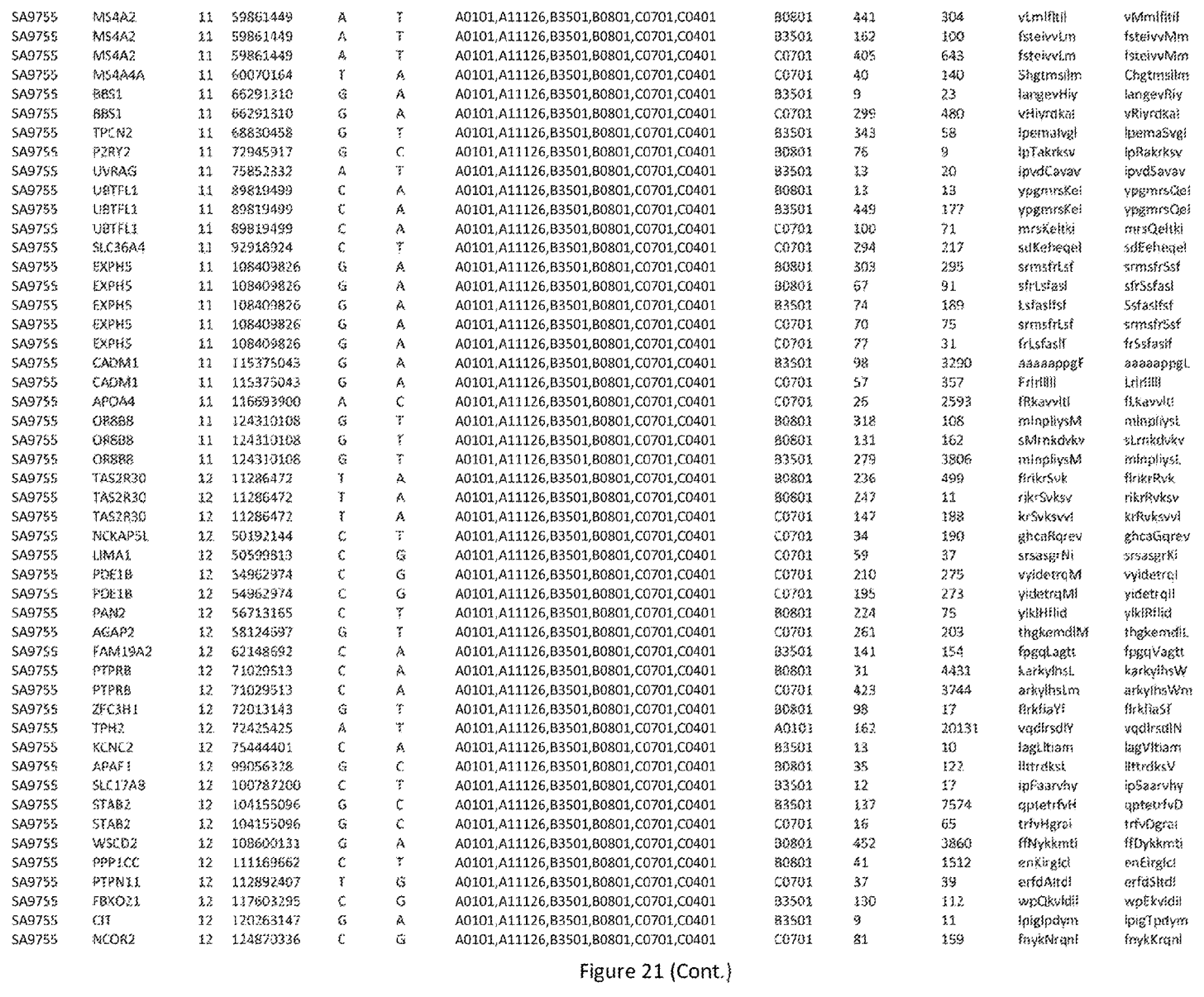
Figure 21:
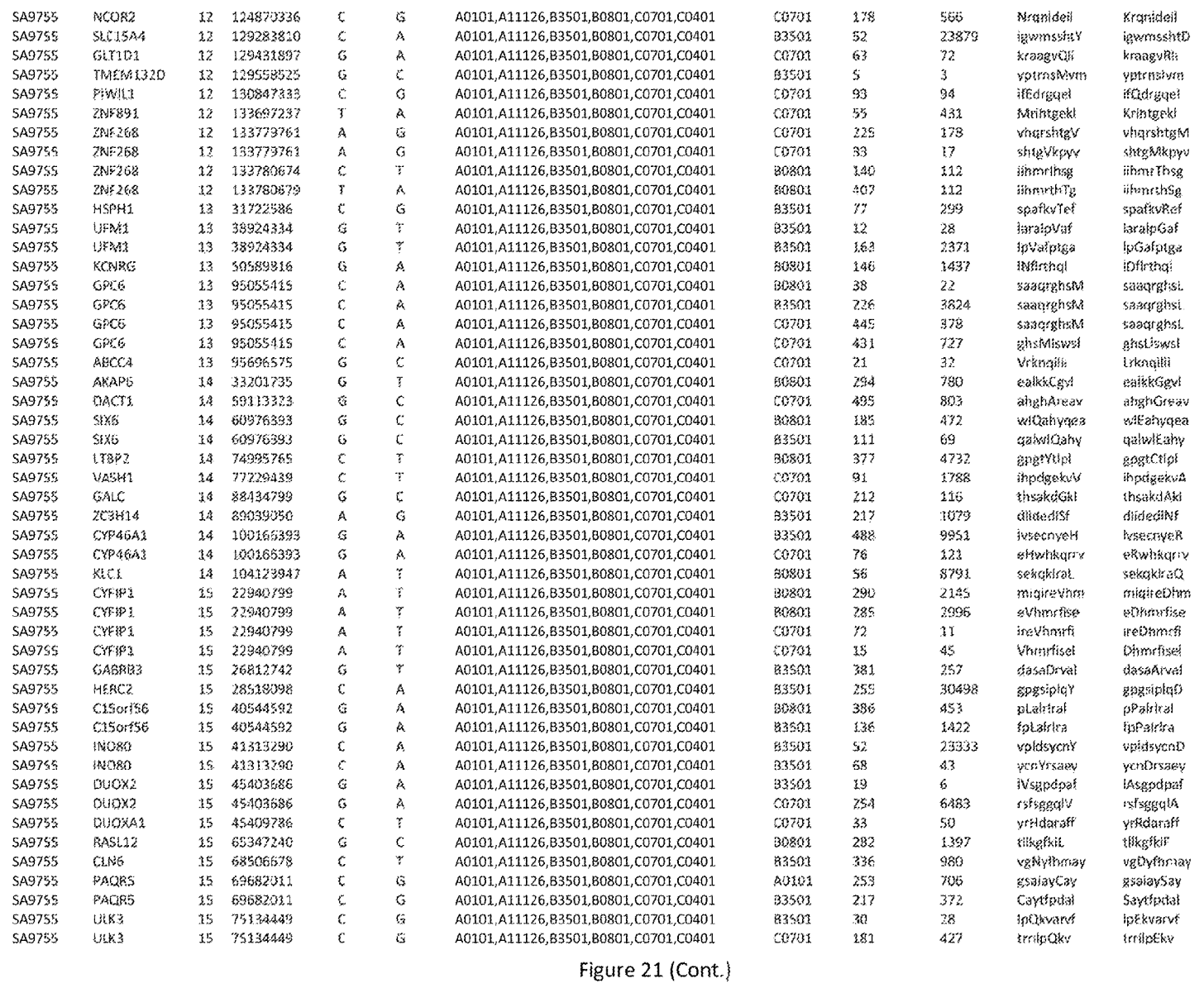
Figure 21:
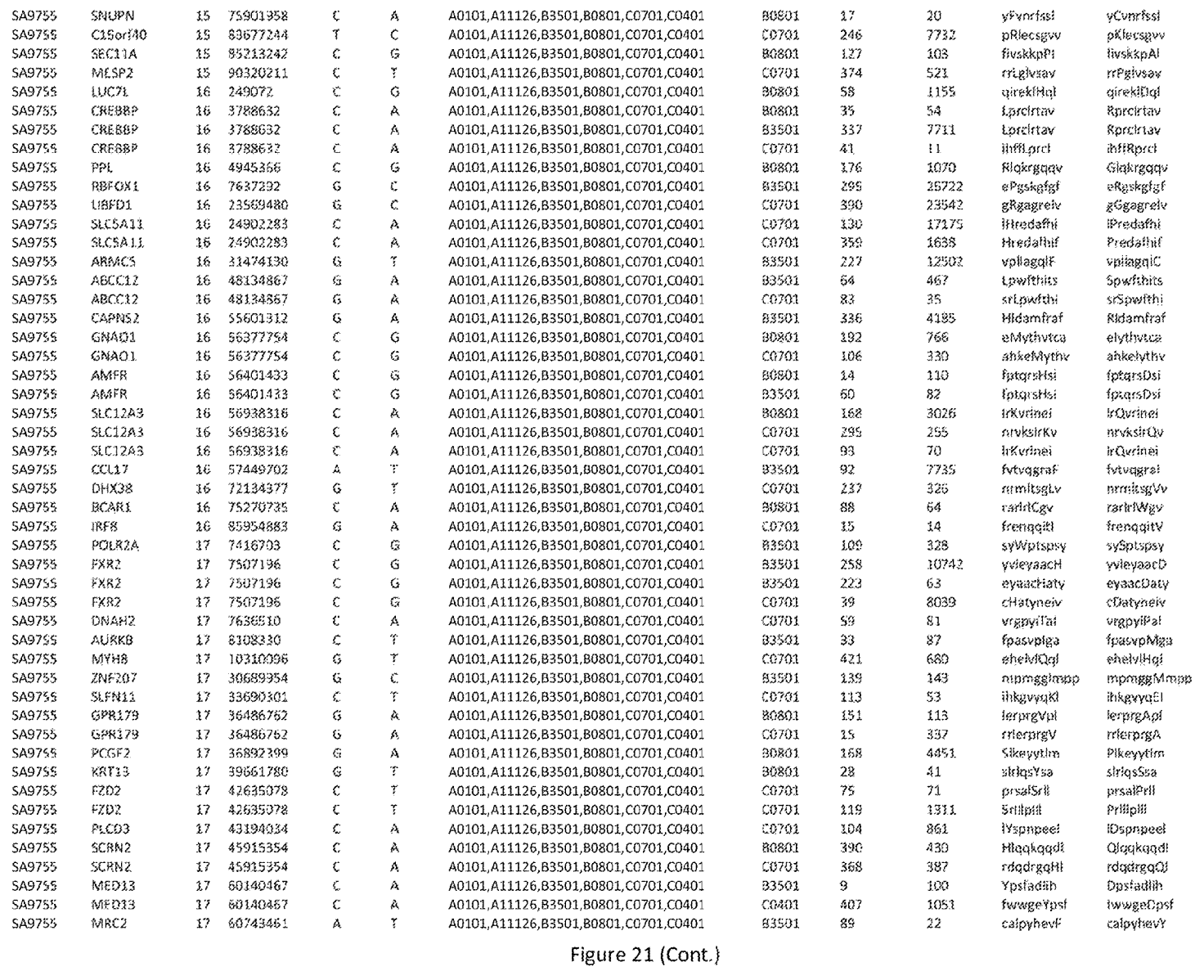
Figure 21:
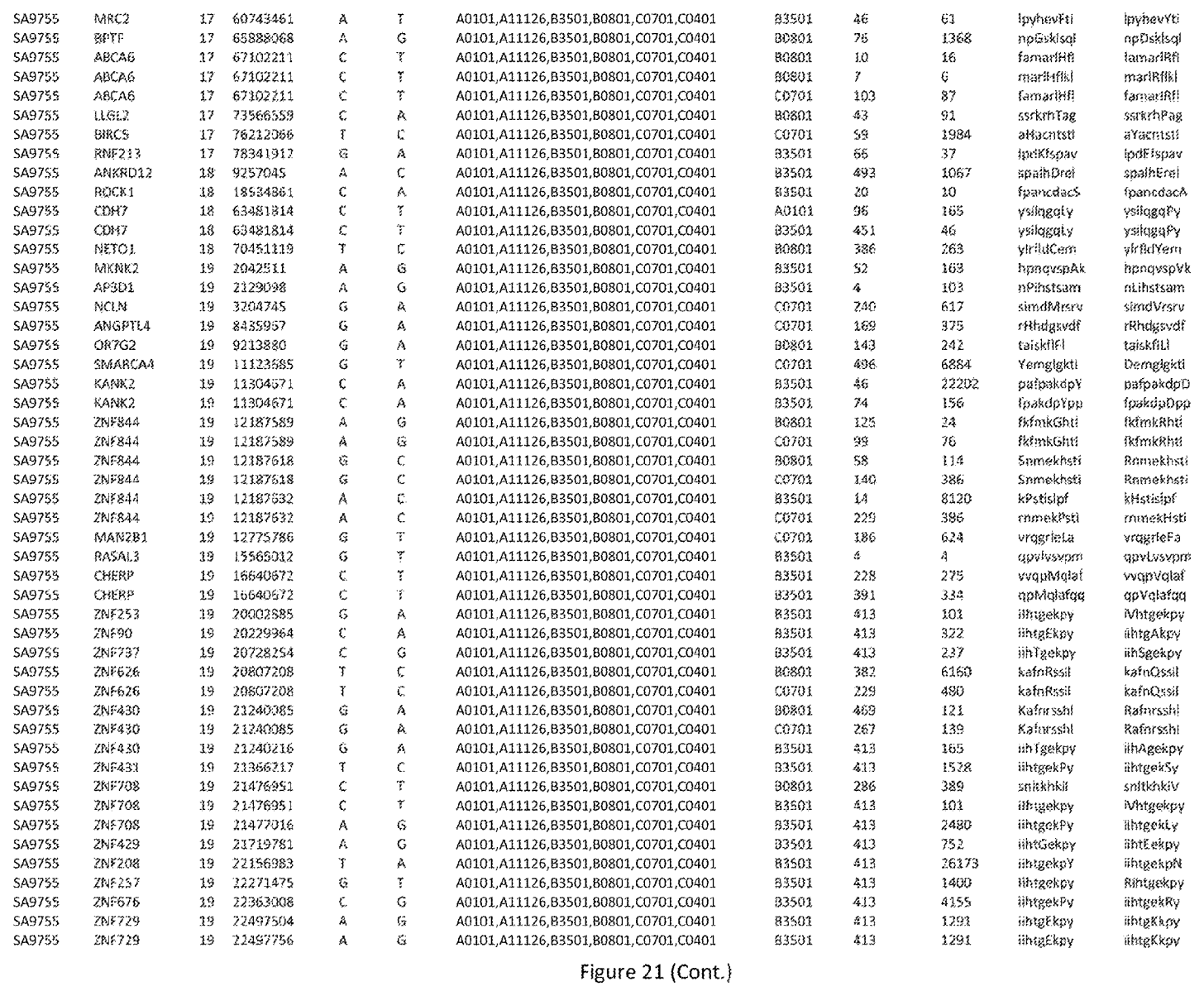
Figure 21:
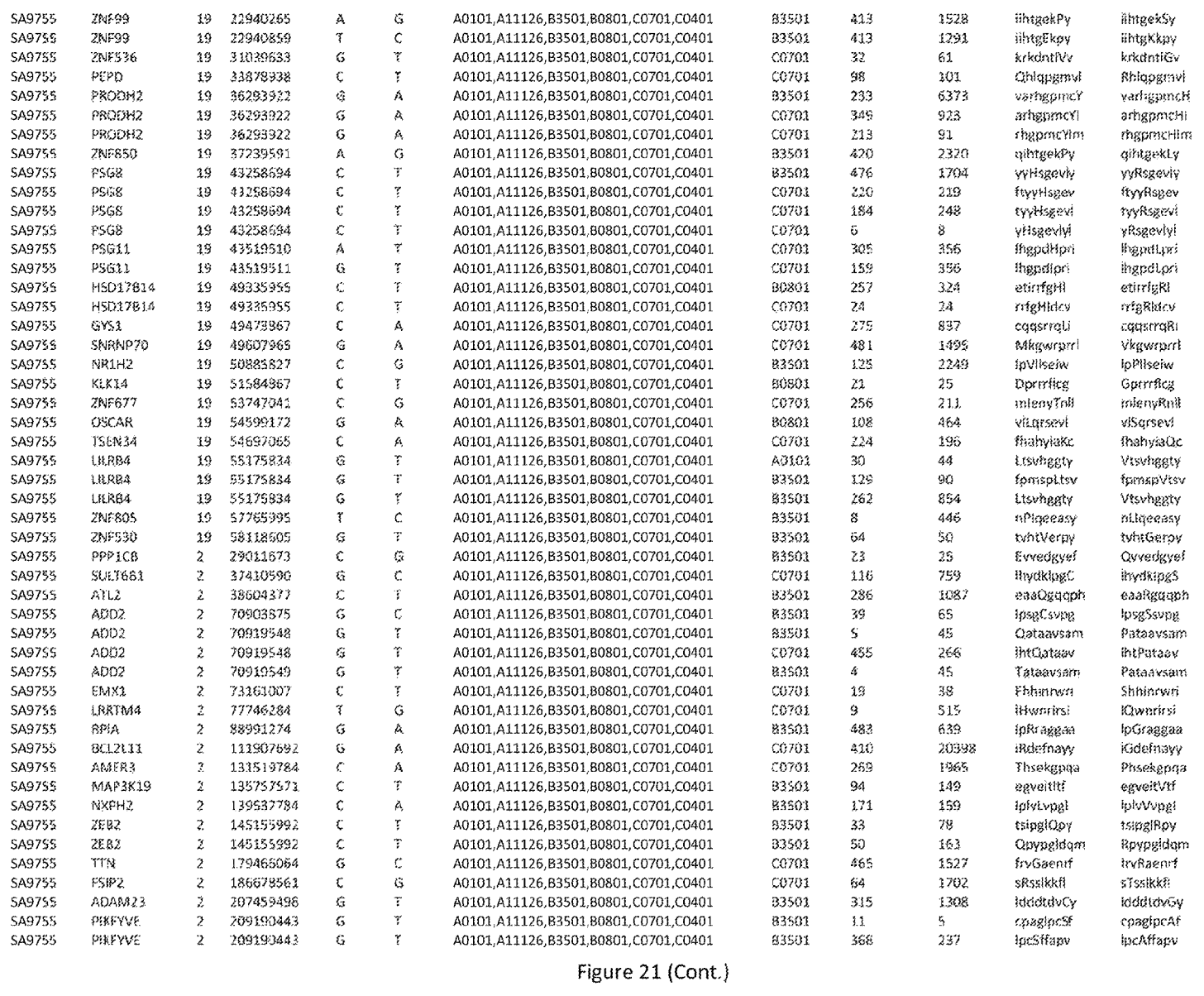
Figure 21:
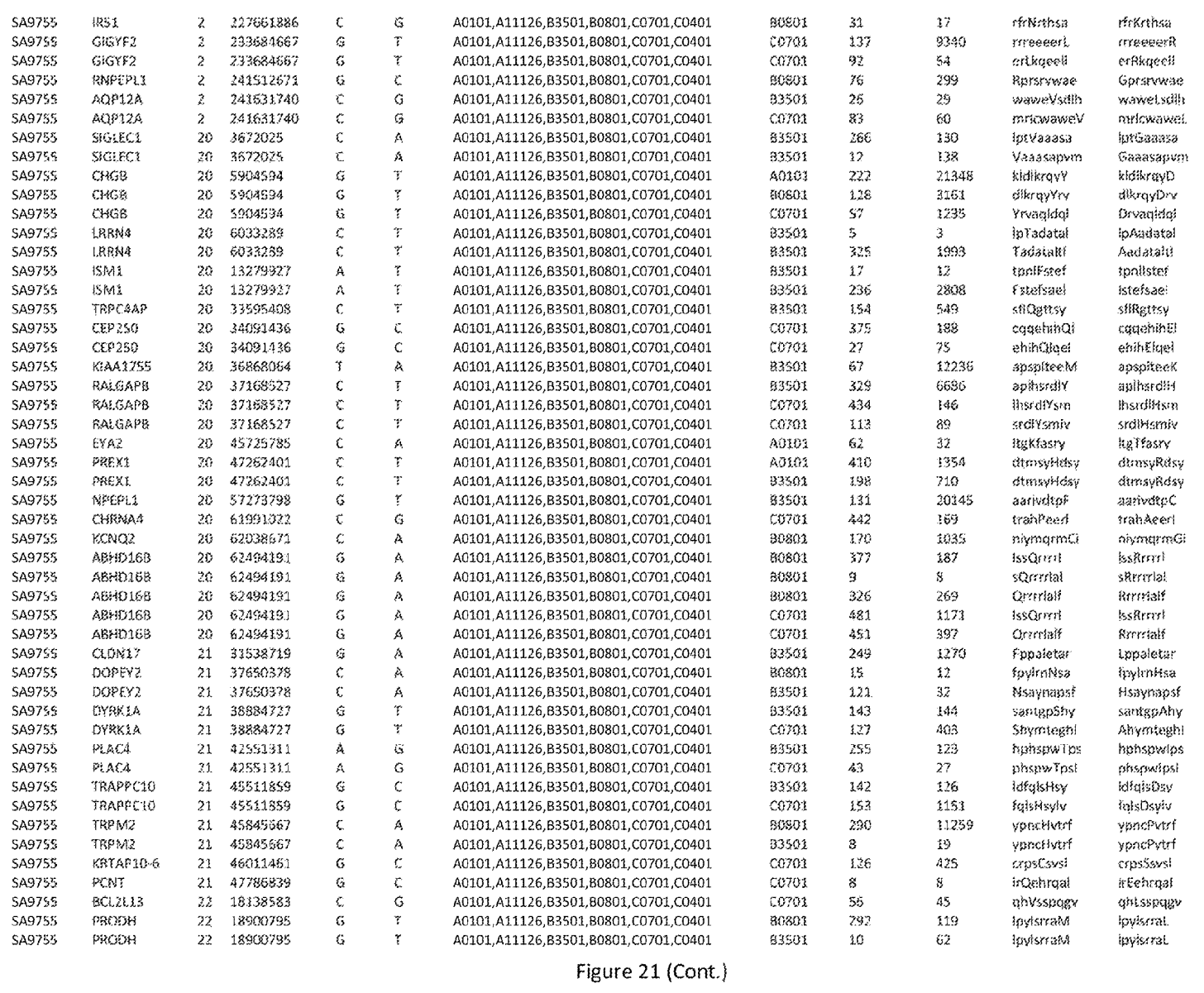
Figure 21:
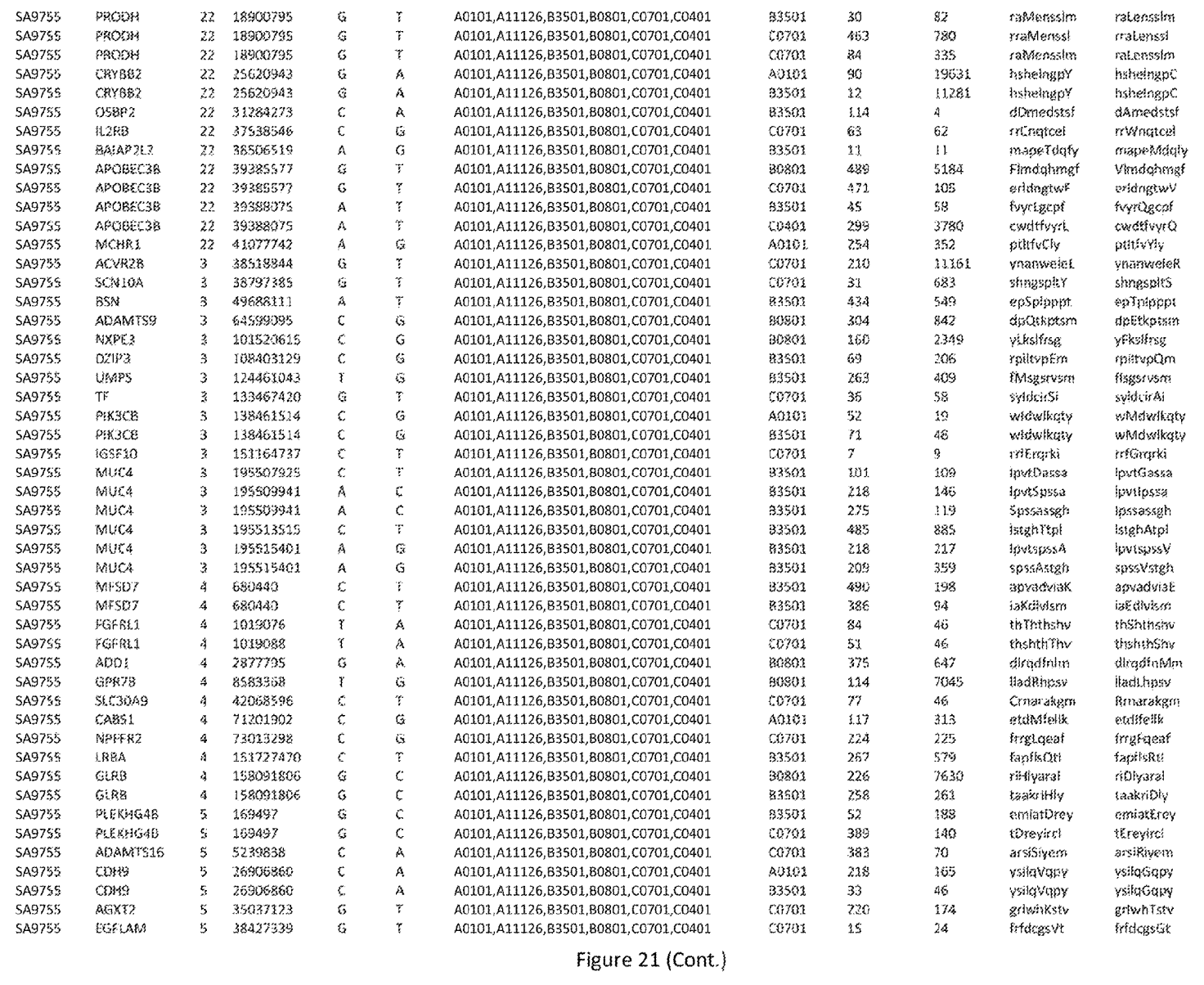
Figure 21:
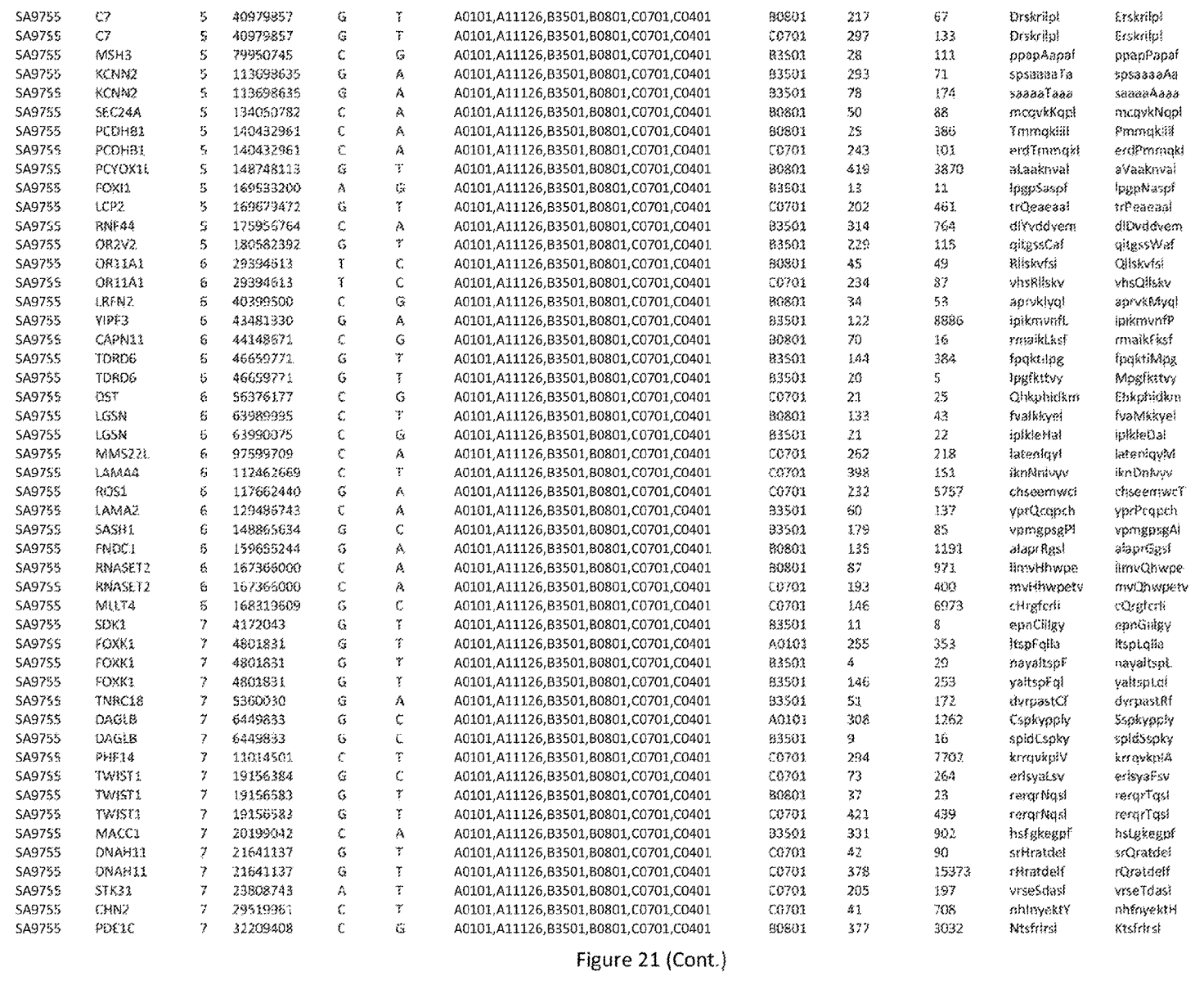
Figure 21:
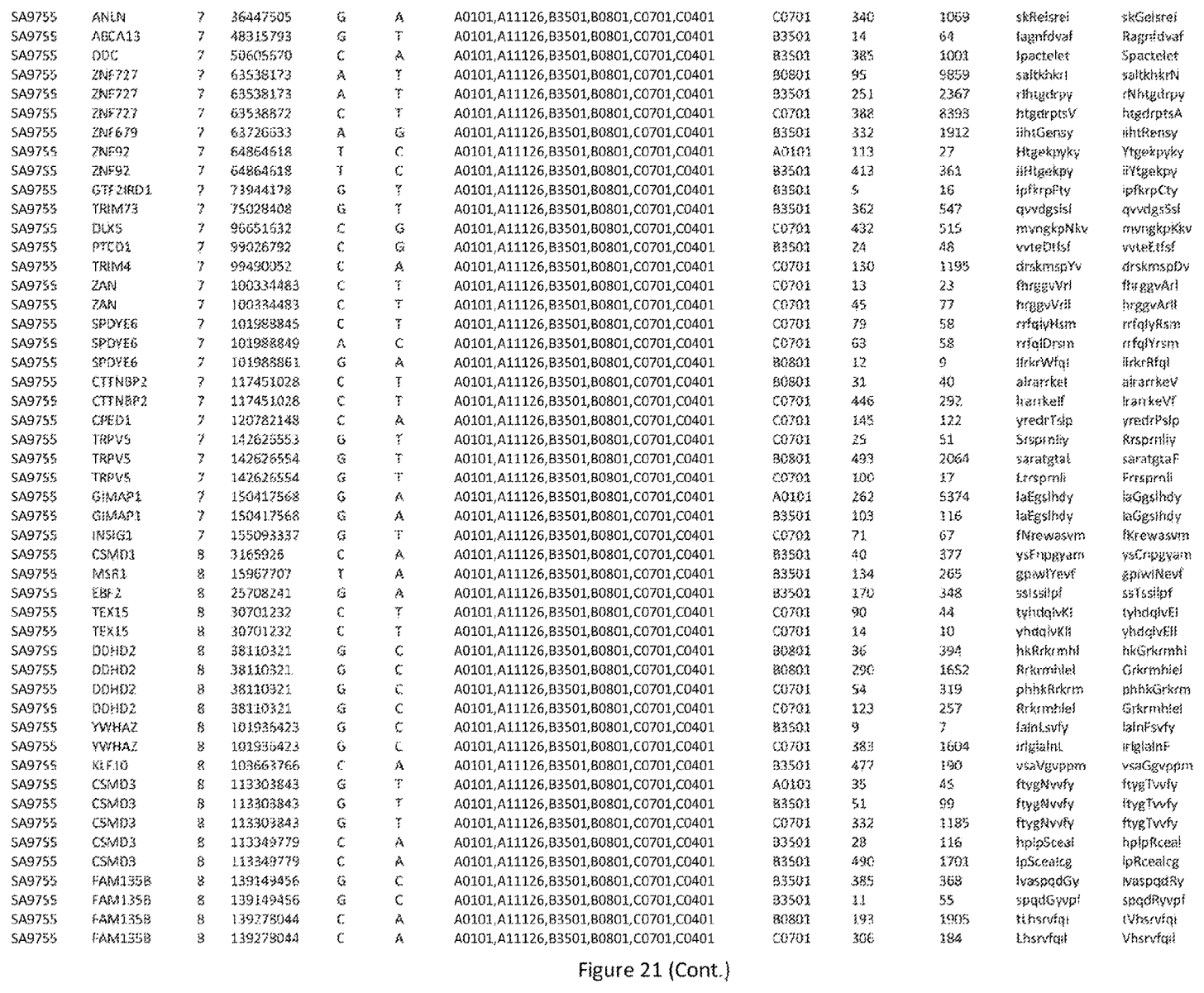
Figure 21:
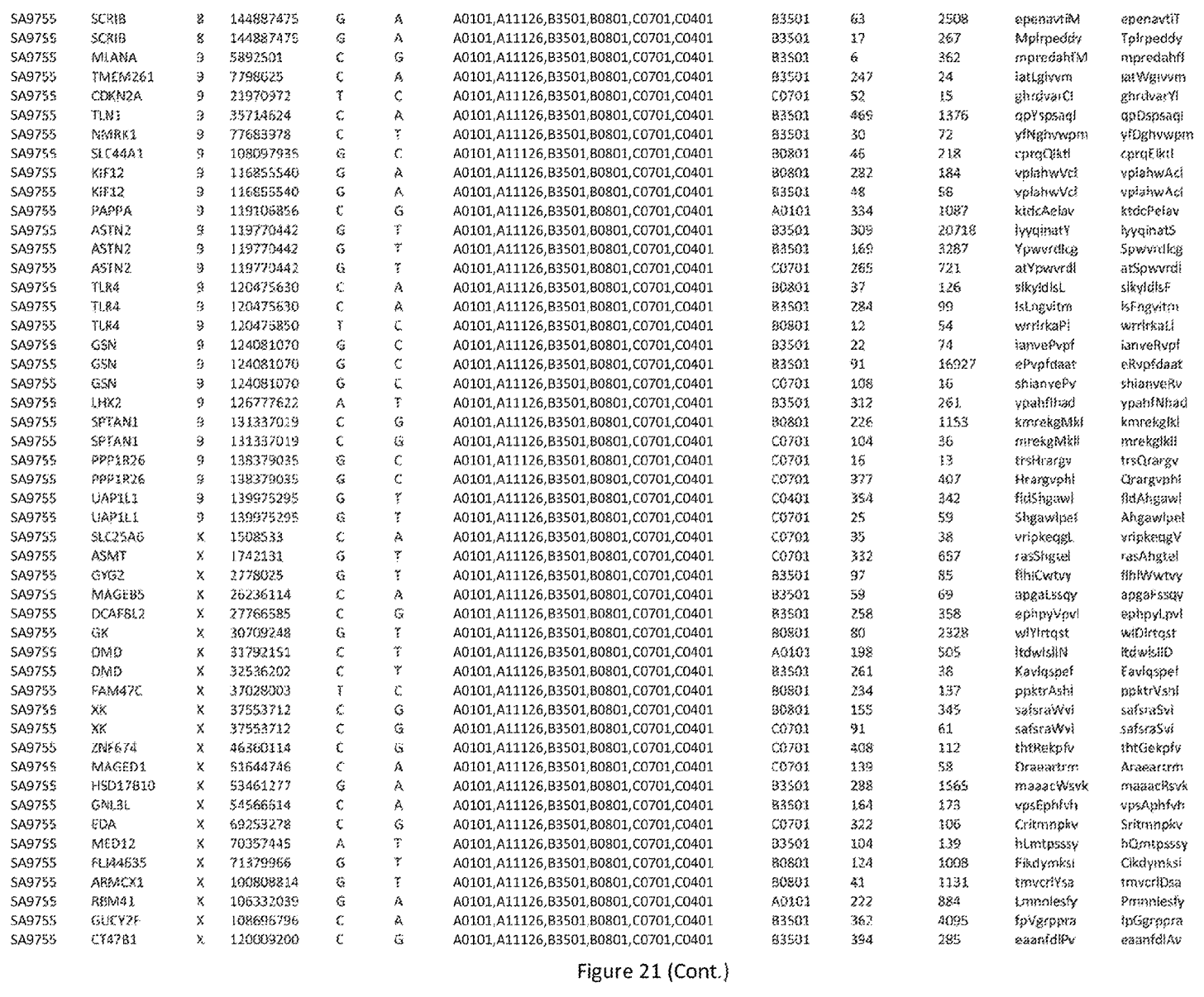
Figure 21:
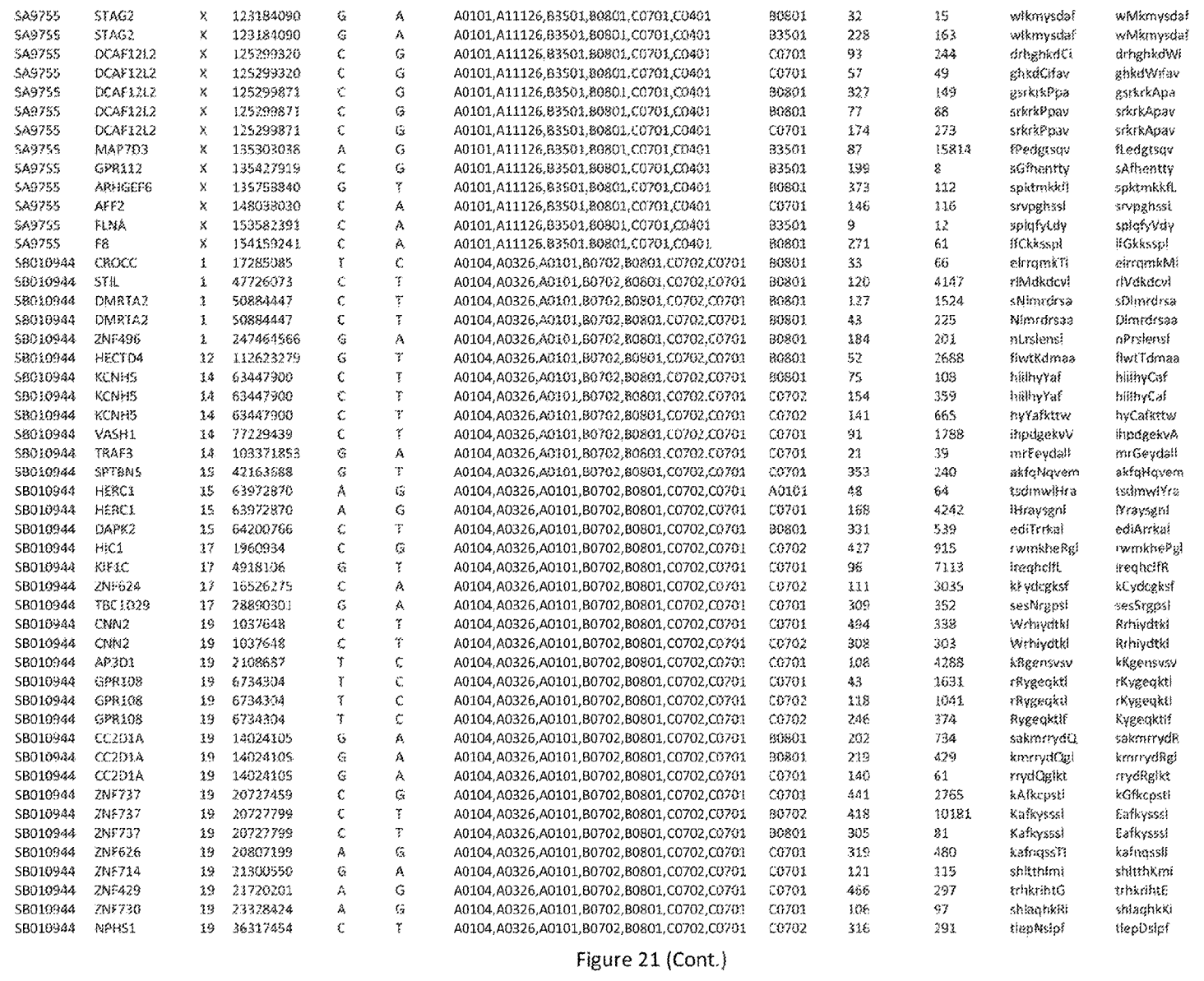
Figure 21:
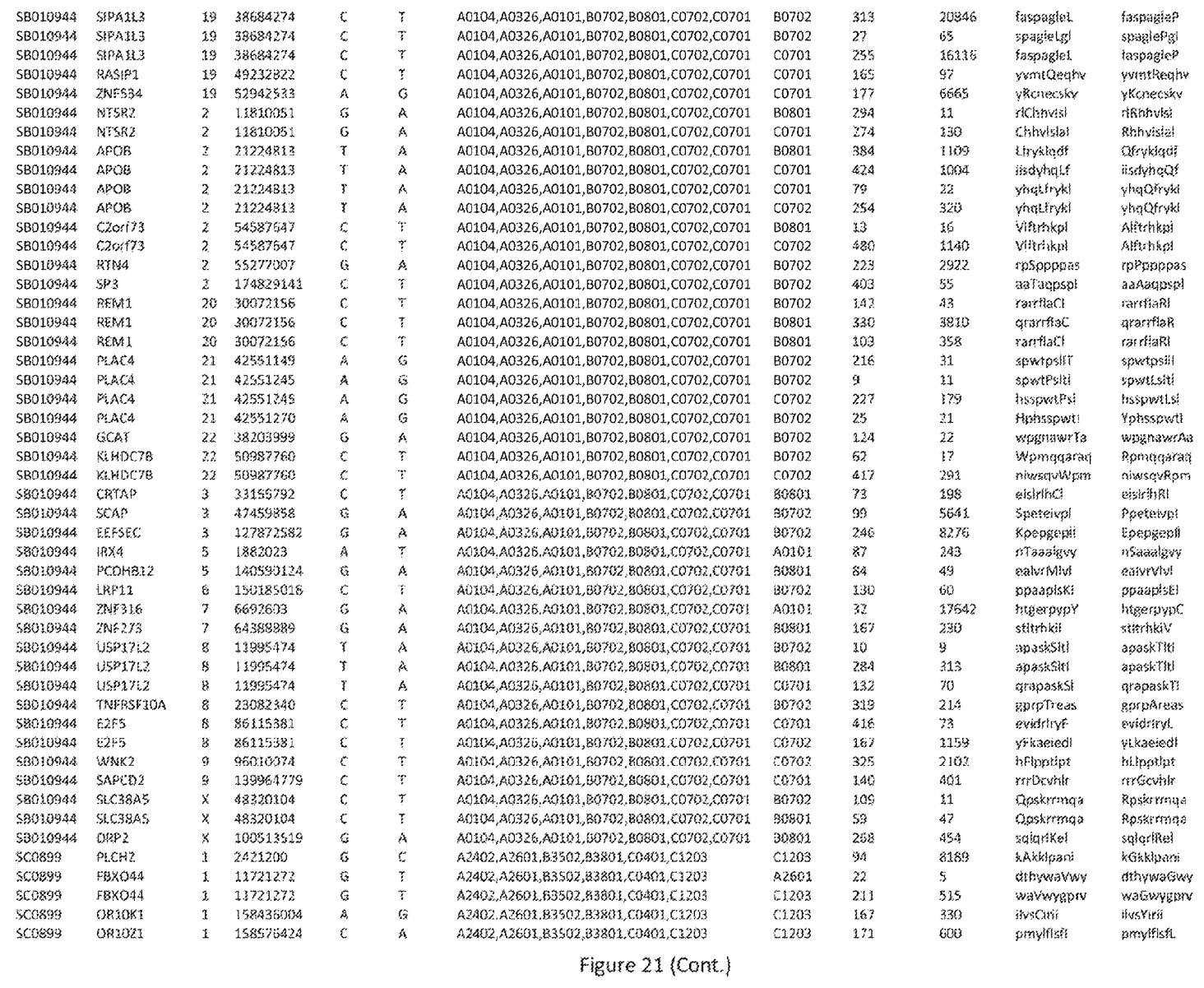
Figure 21:
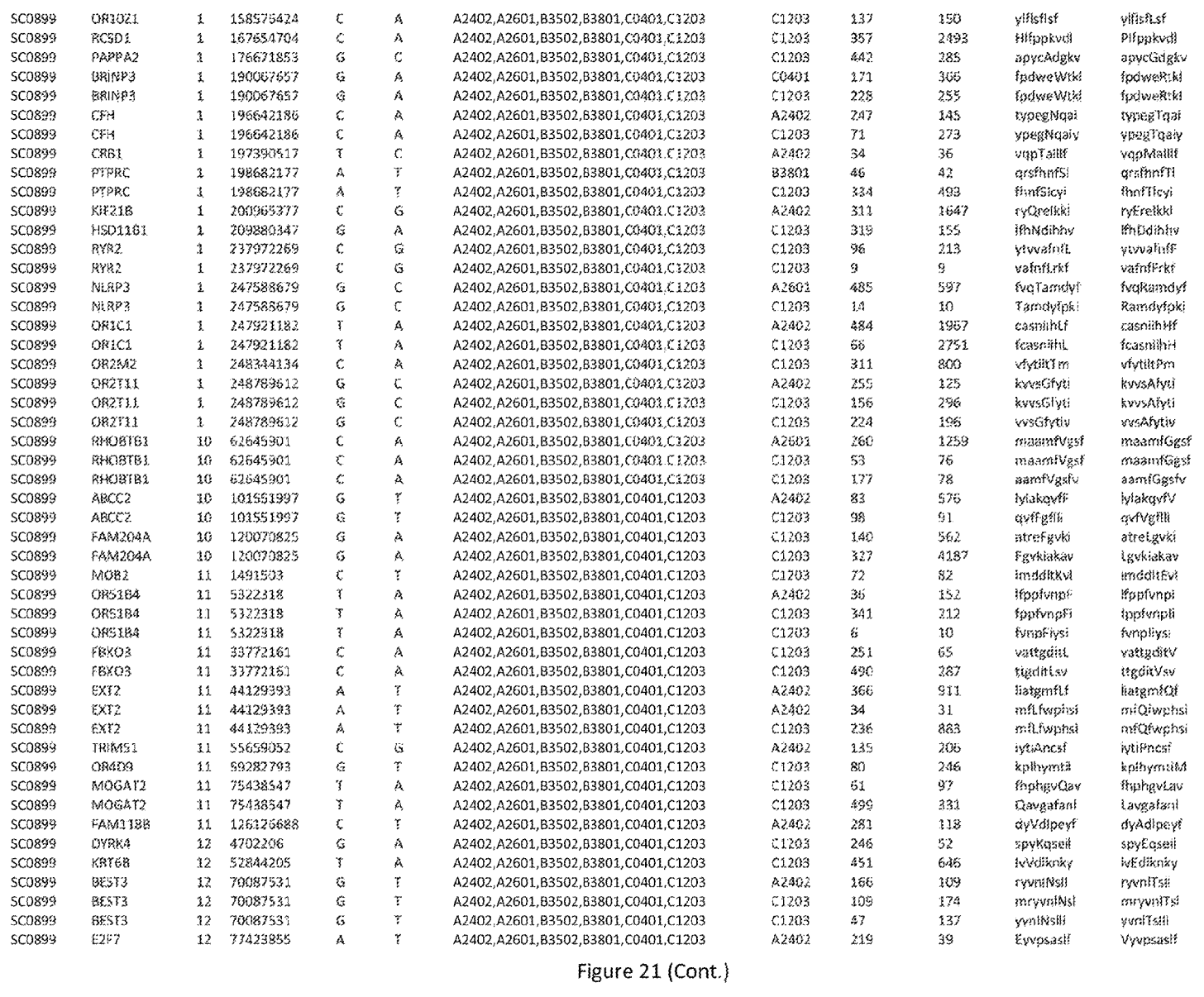
Figure 21:
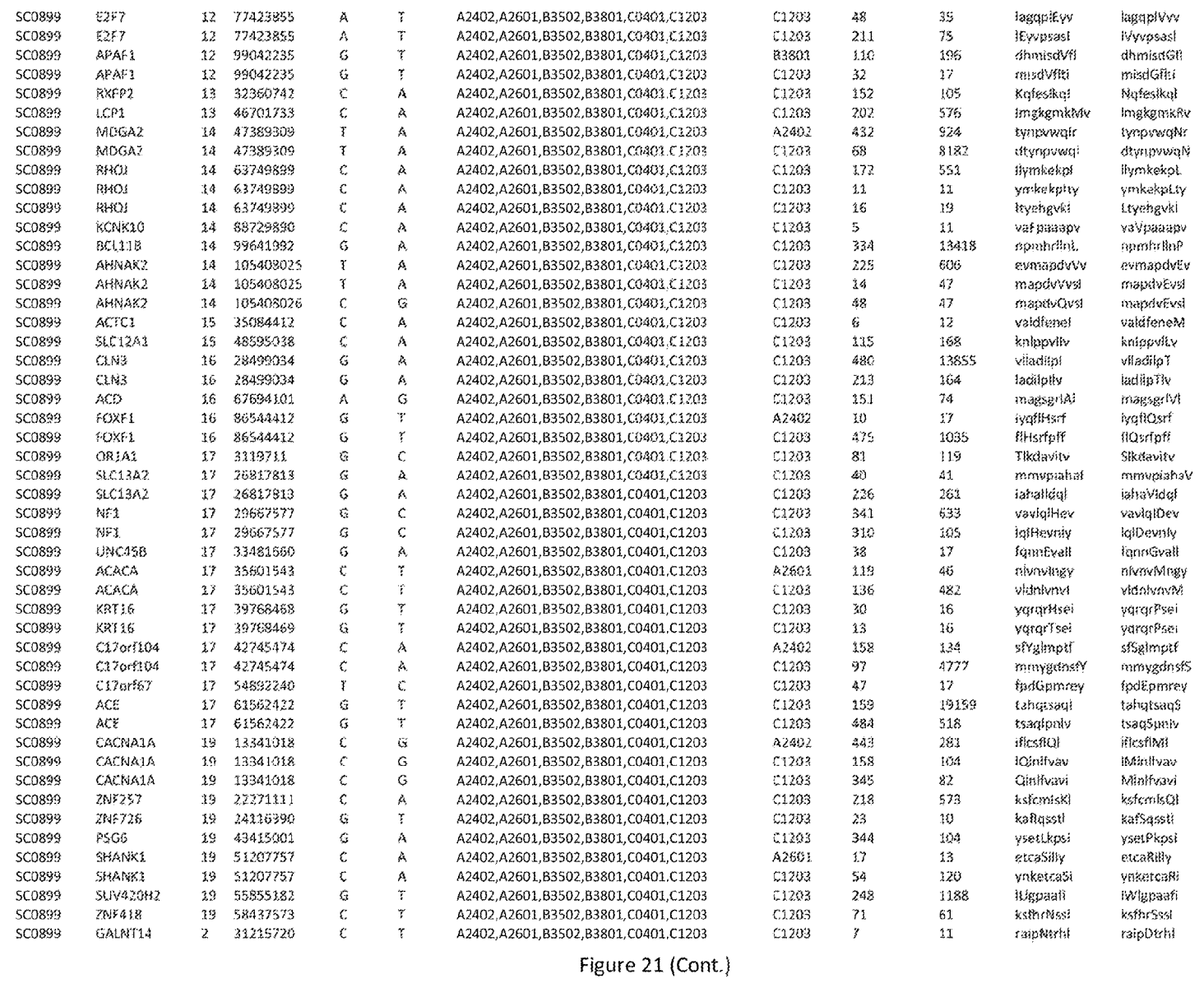
Figure 21:
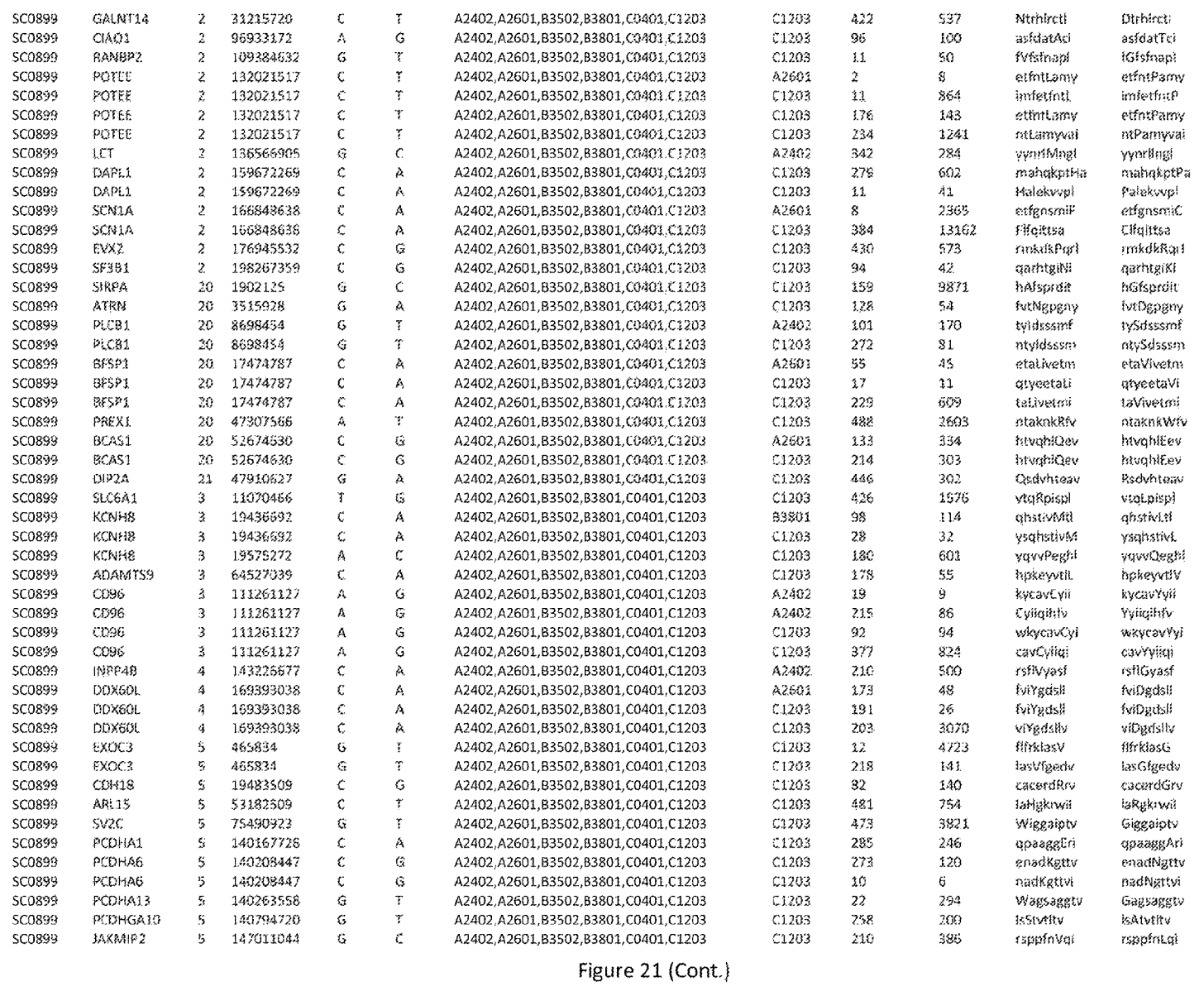
Figure 21:
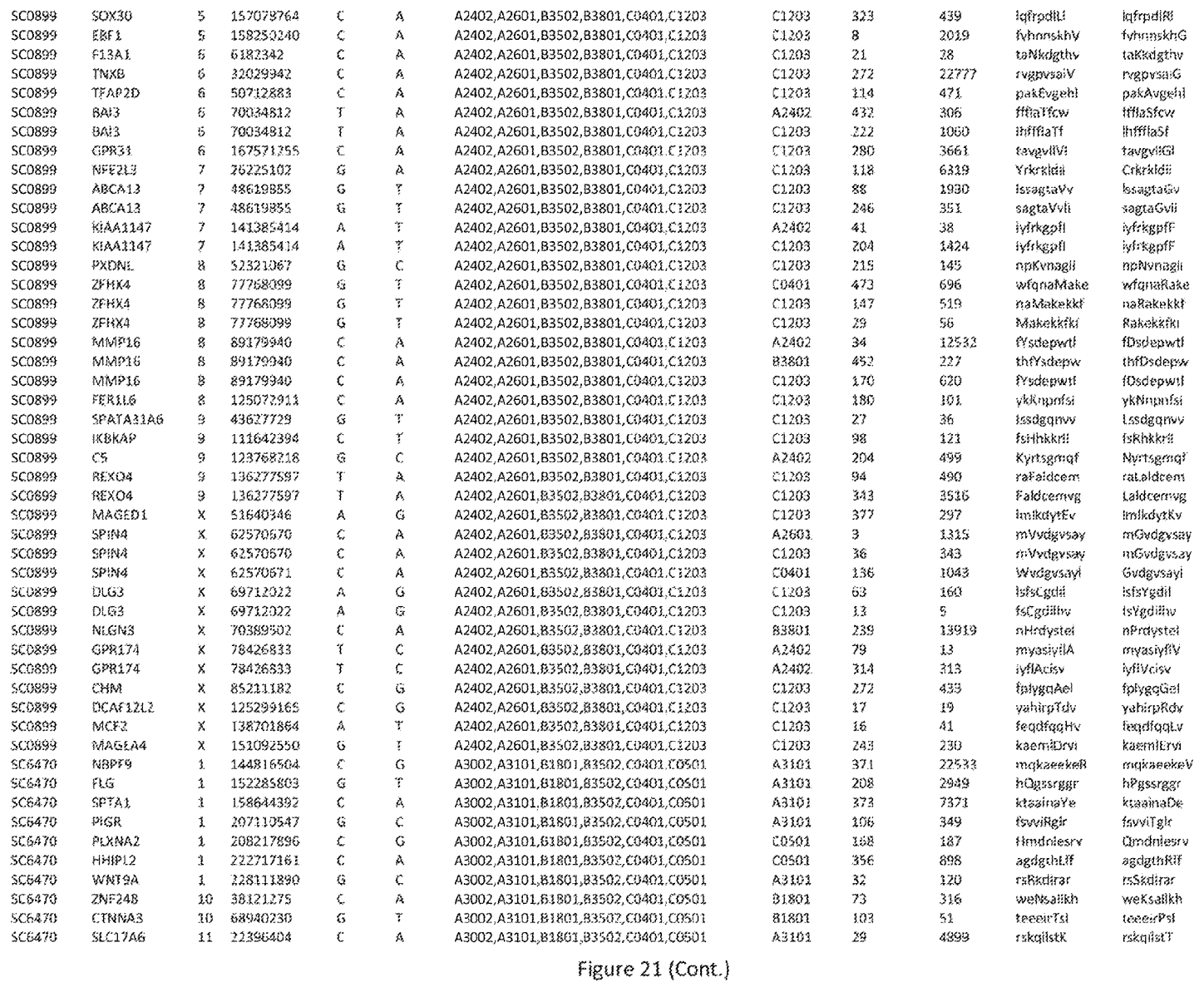
Figure 21:
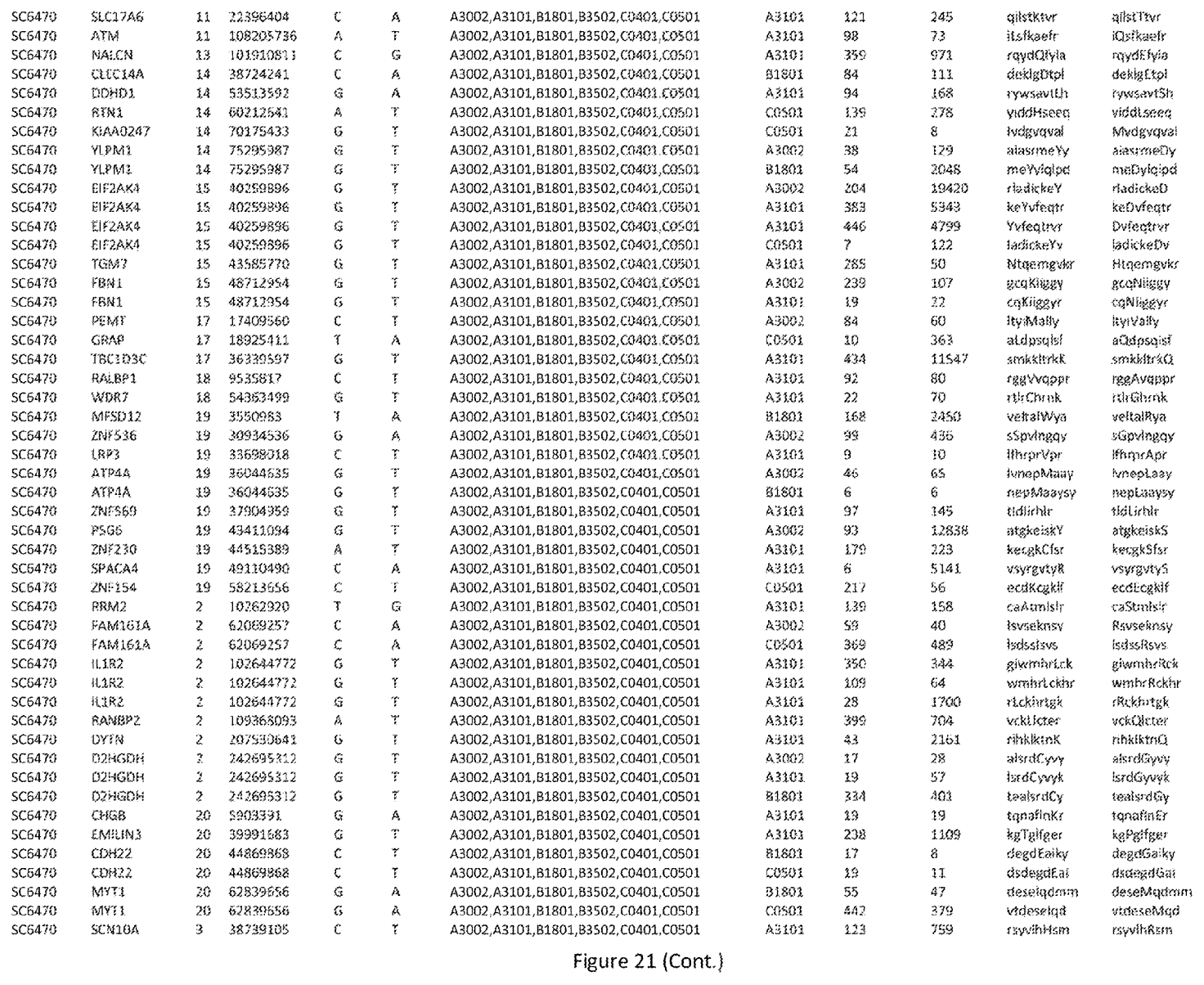
Figure 21:
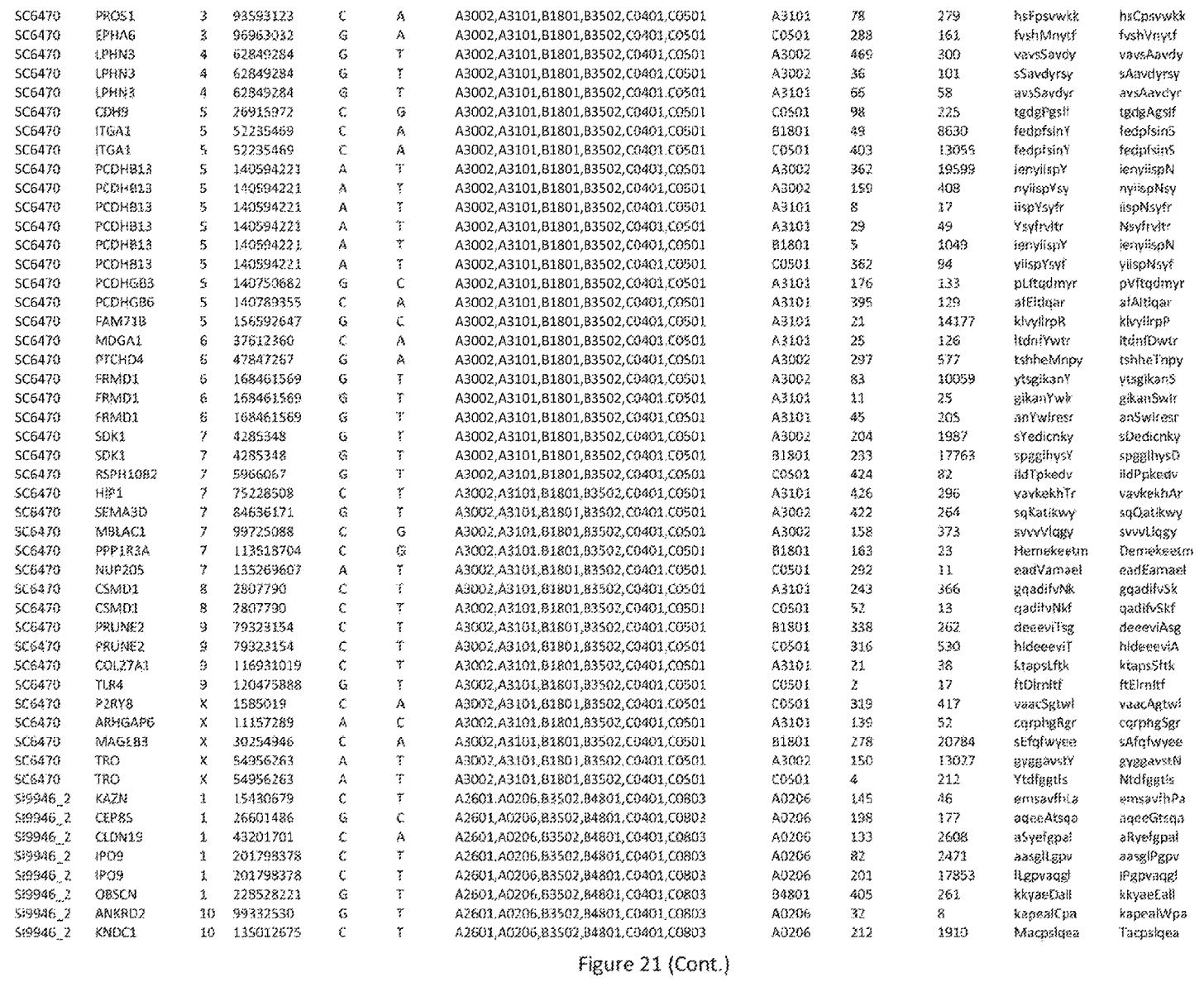
Figure 21:
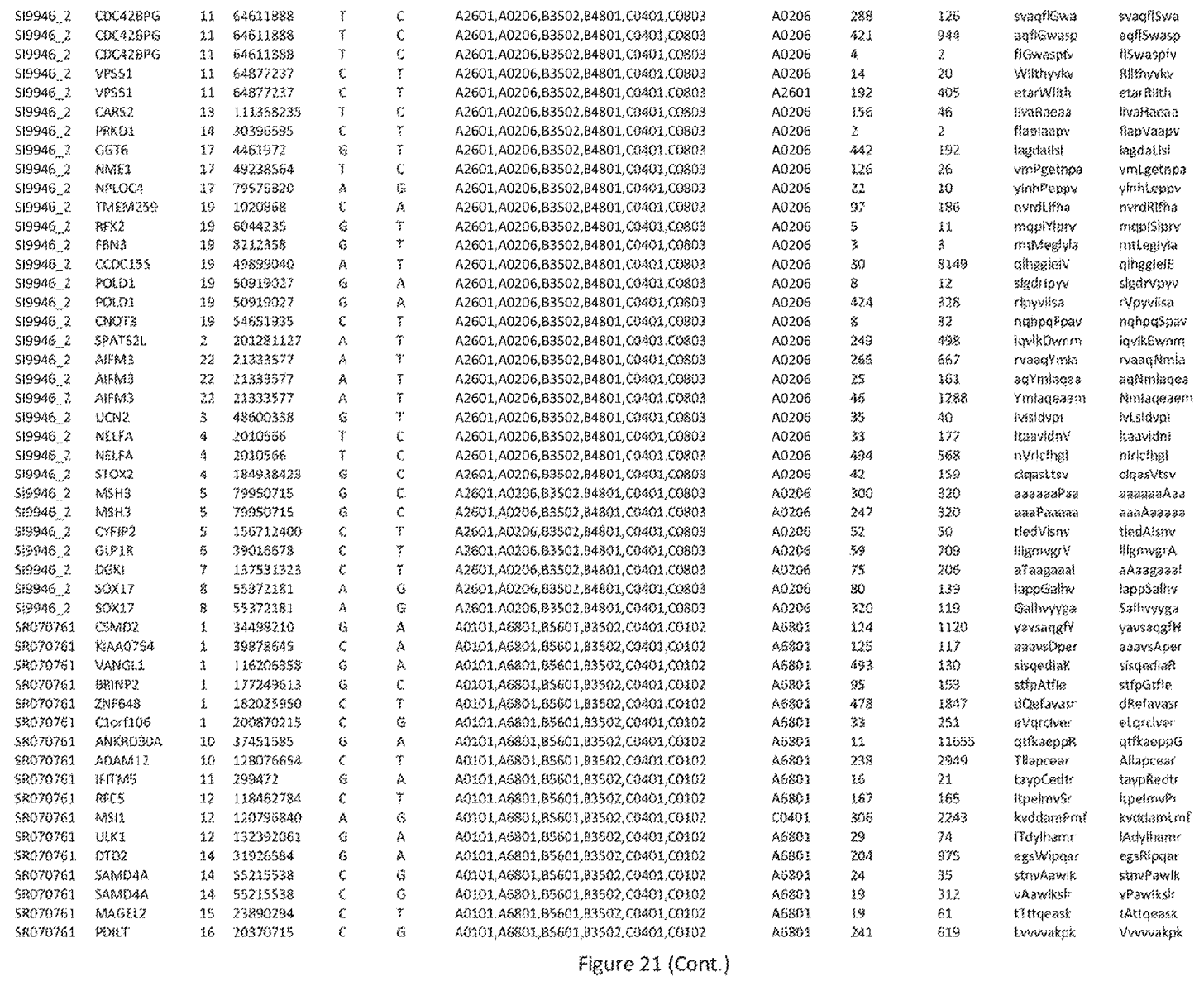
Figure 21:
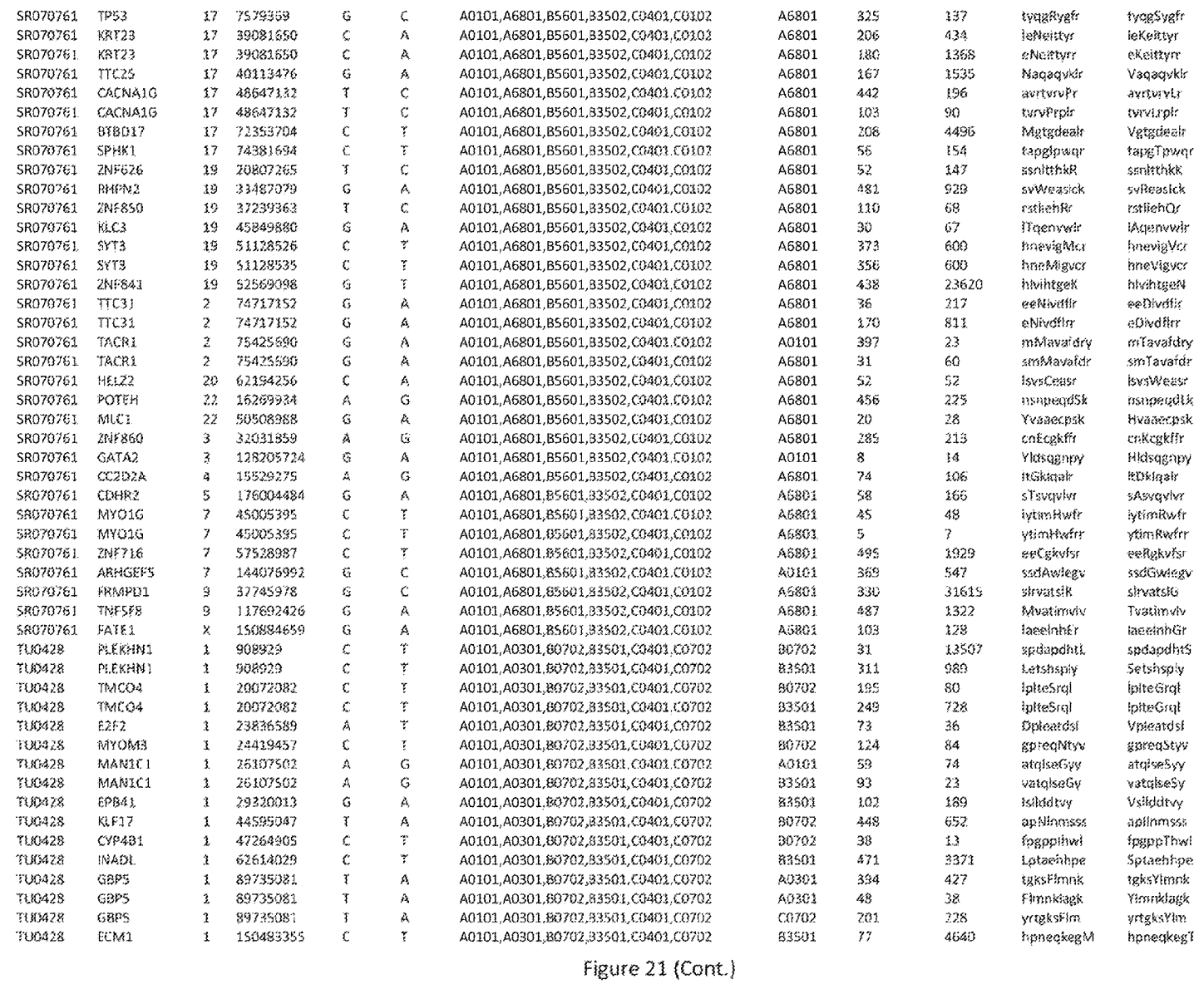
Figure 21:
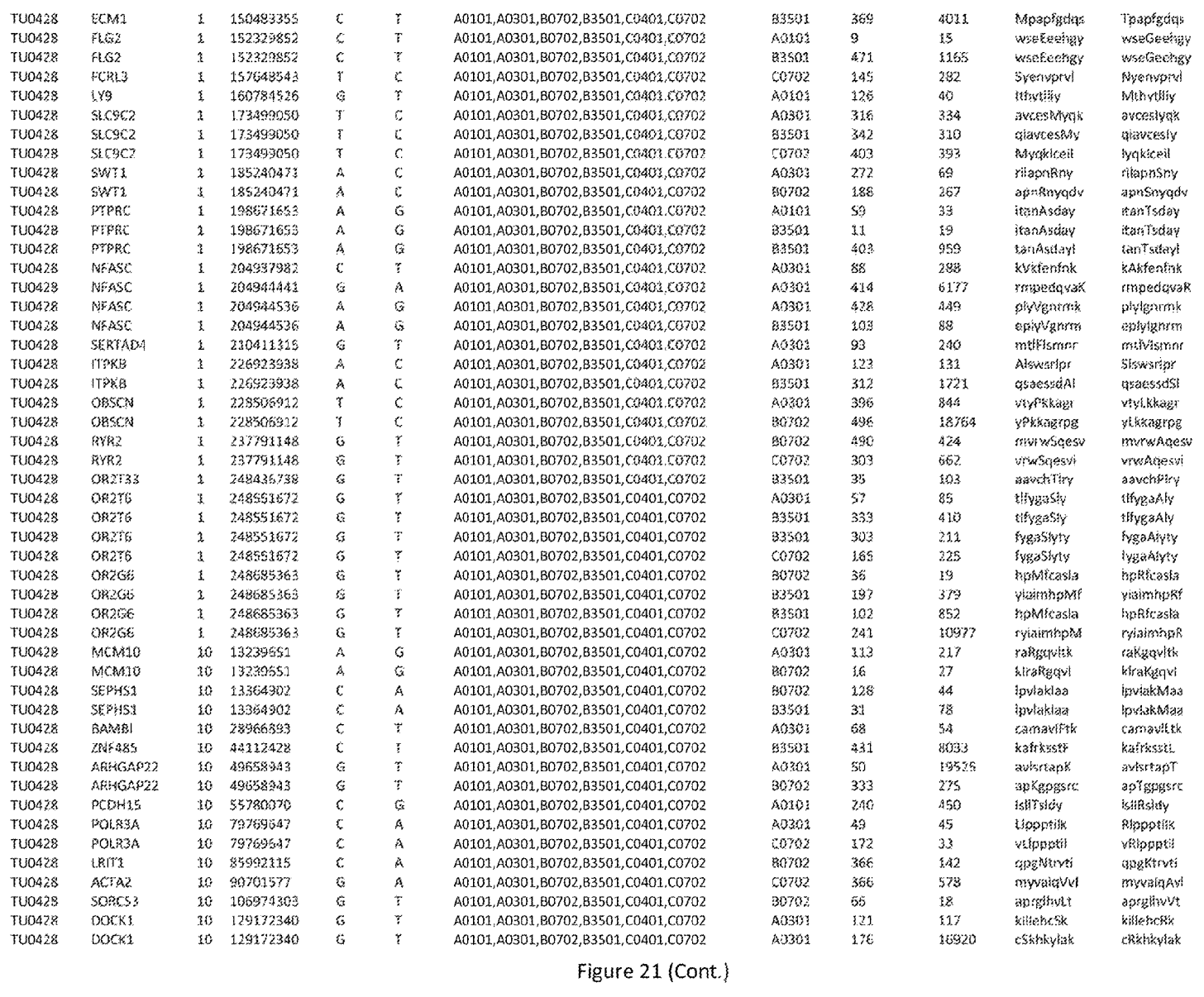
Figure 21:
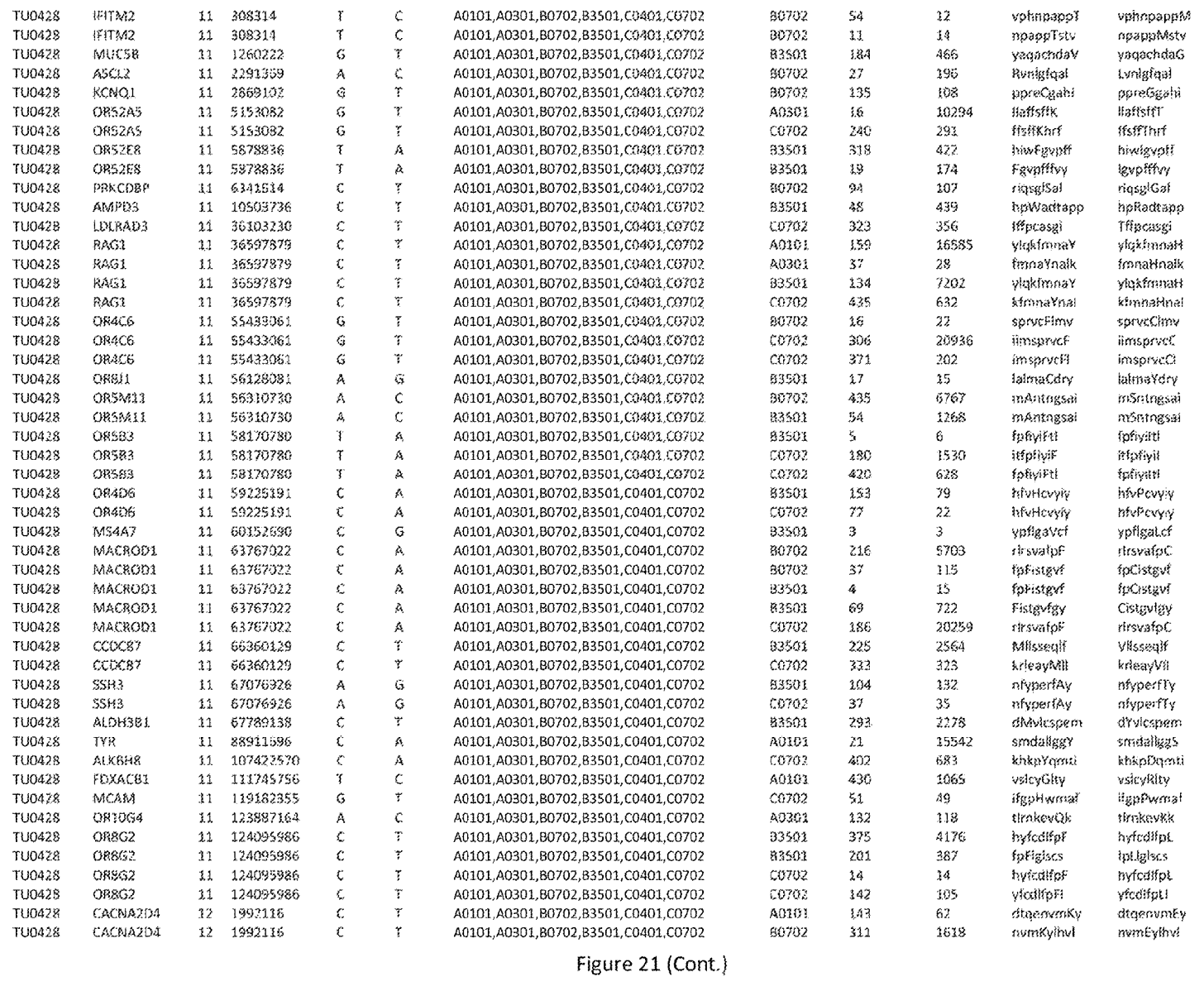
Figure 21:
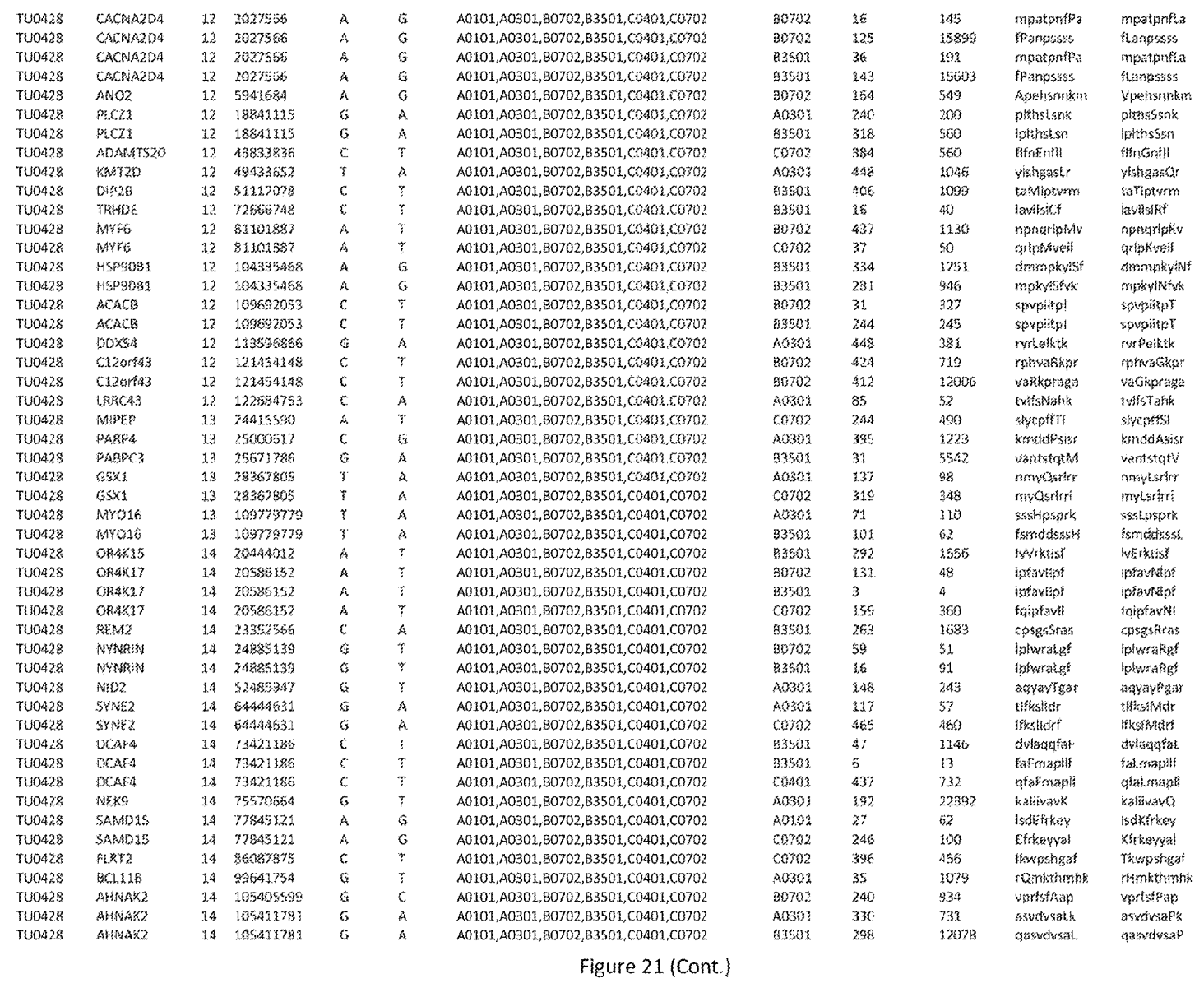
Figure 21:
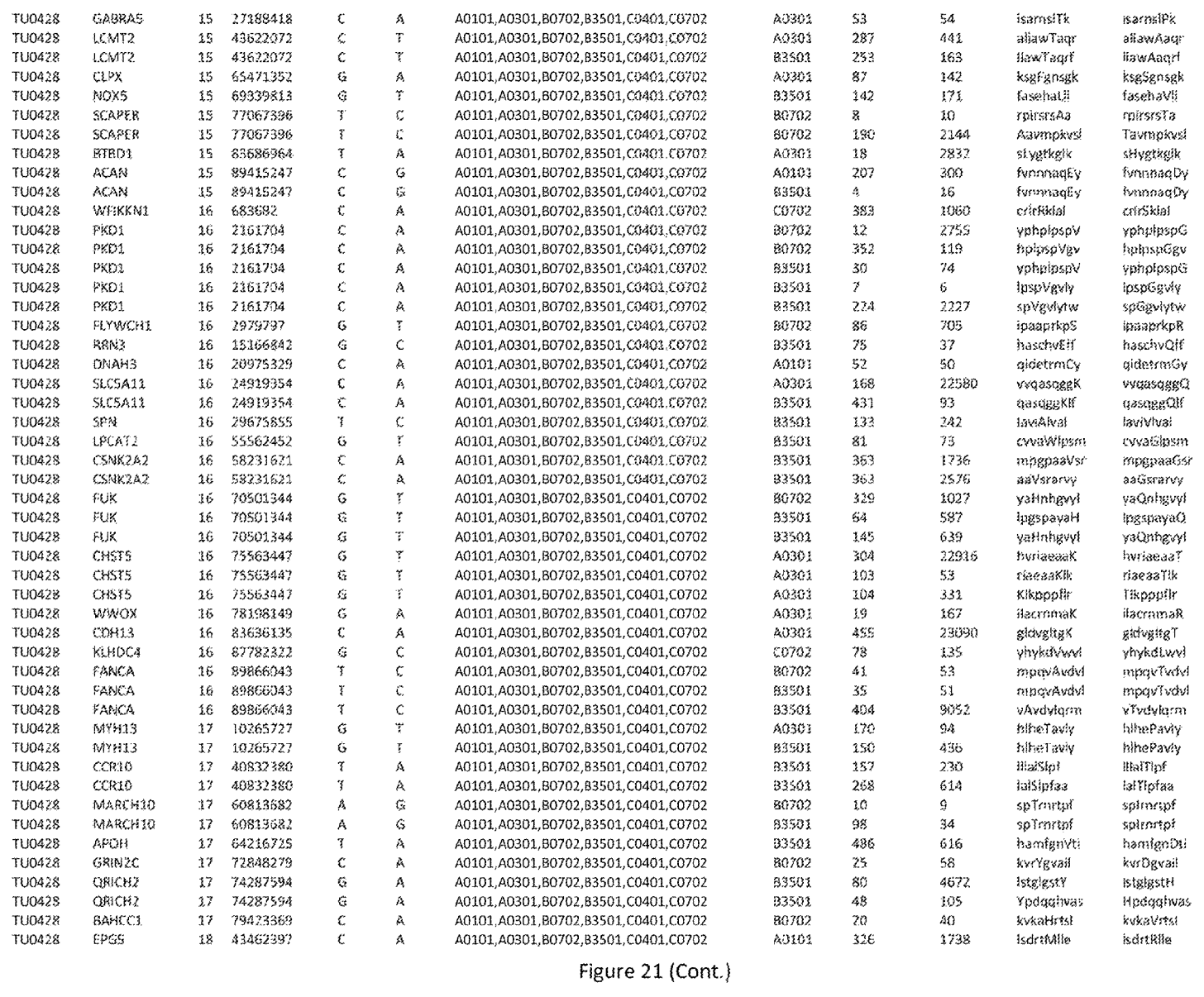
Figure 21:
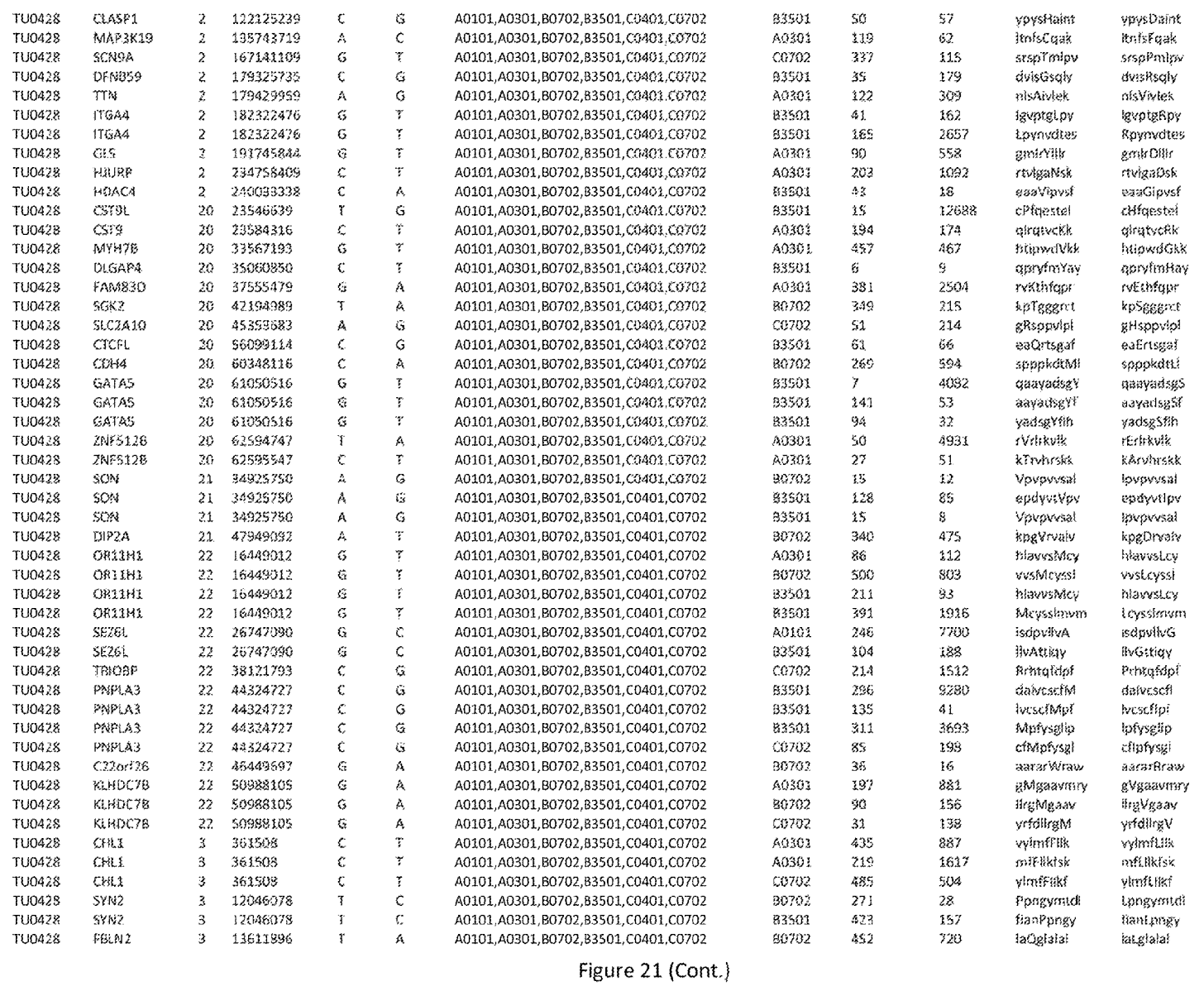
Figure 21:
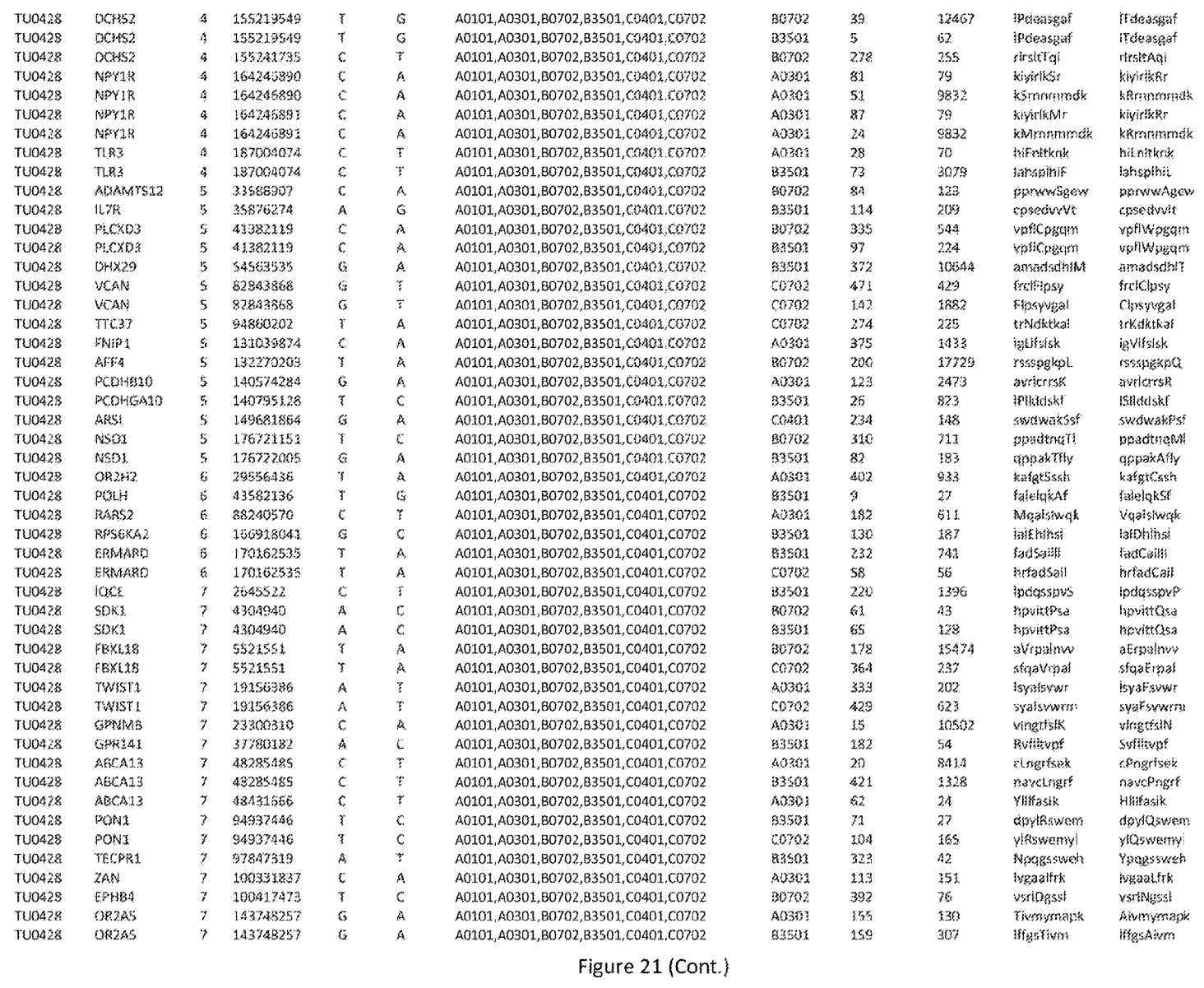
Figure 21:
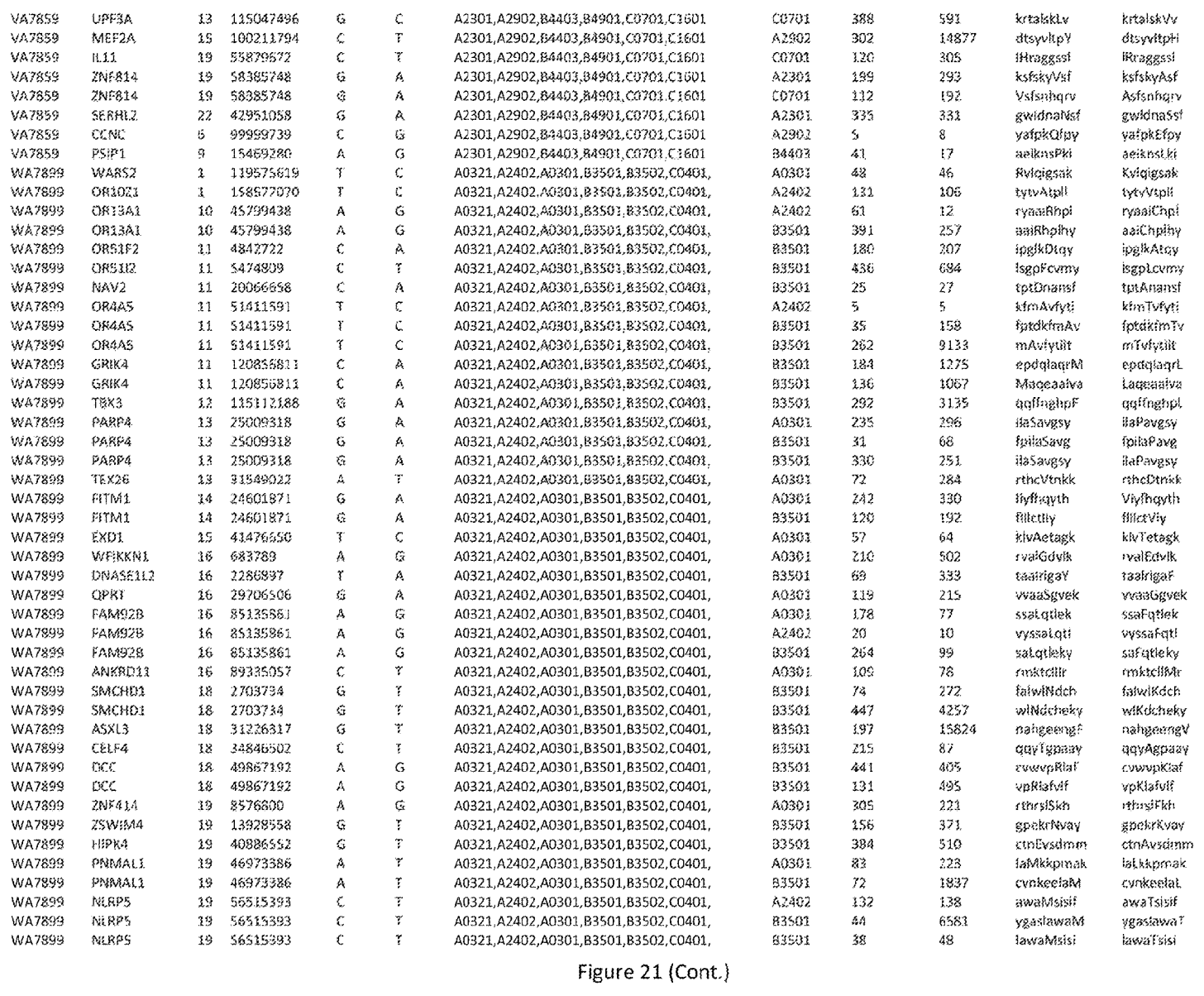
Figure 21:
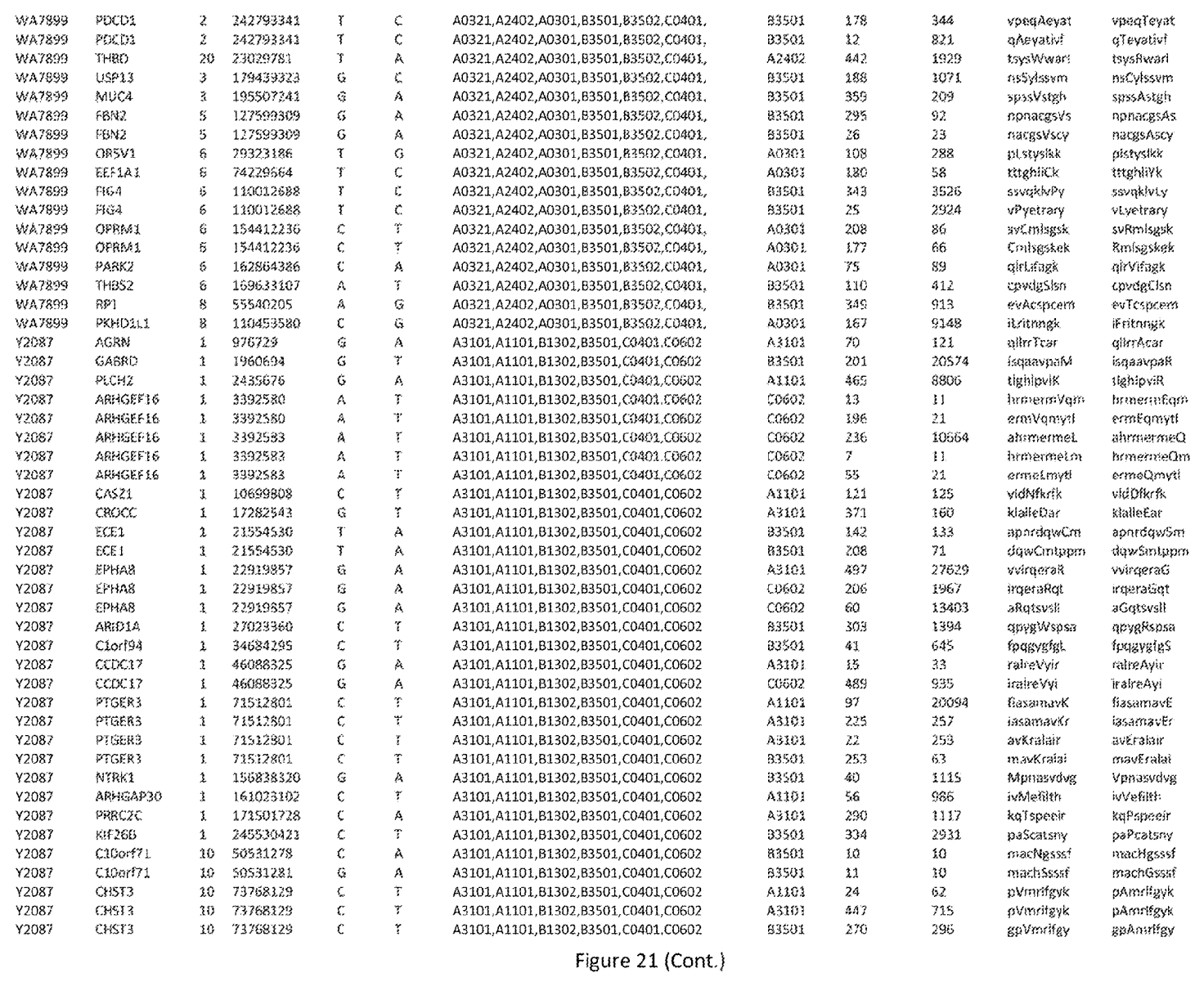
Figure 21:
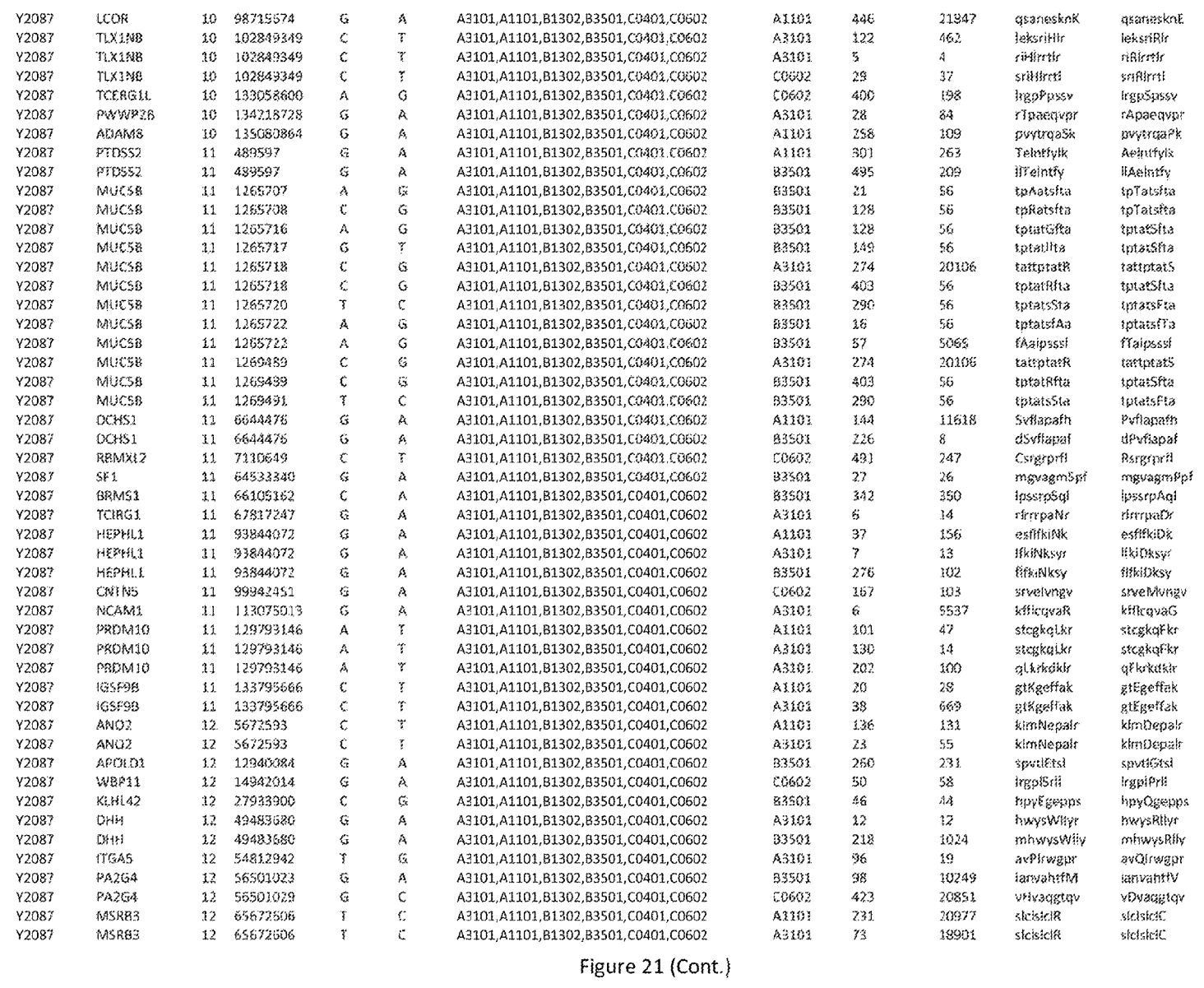
Figure 21:
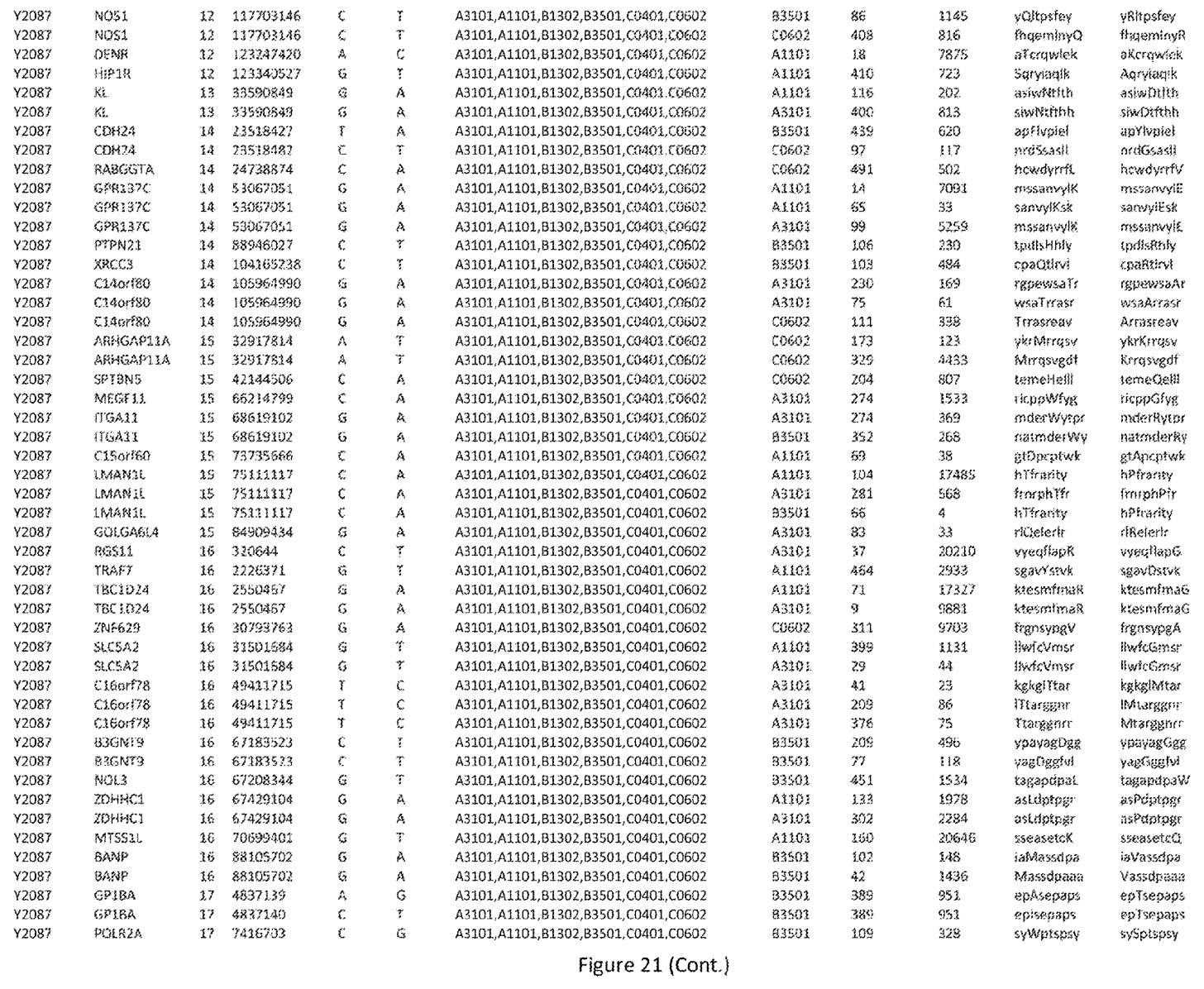
Figure 21:
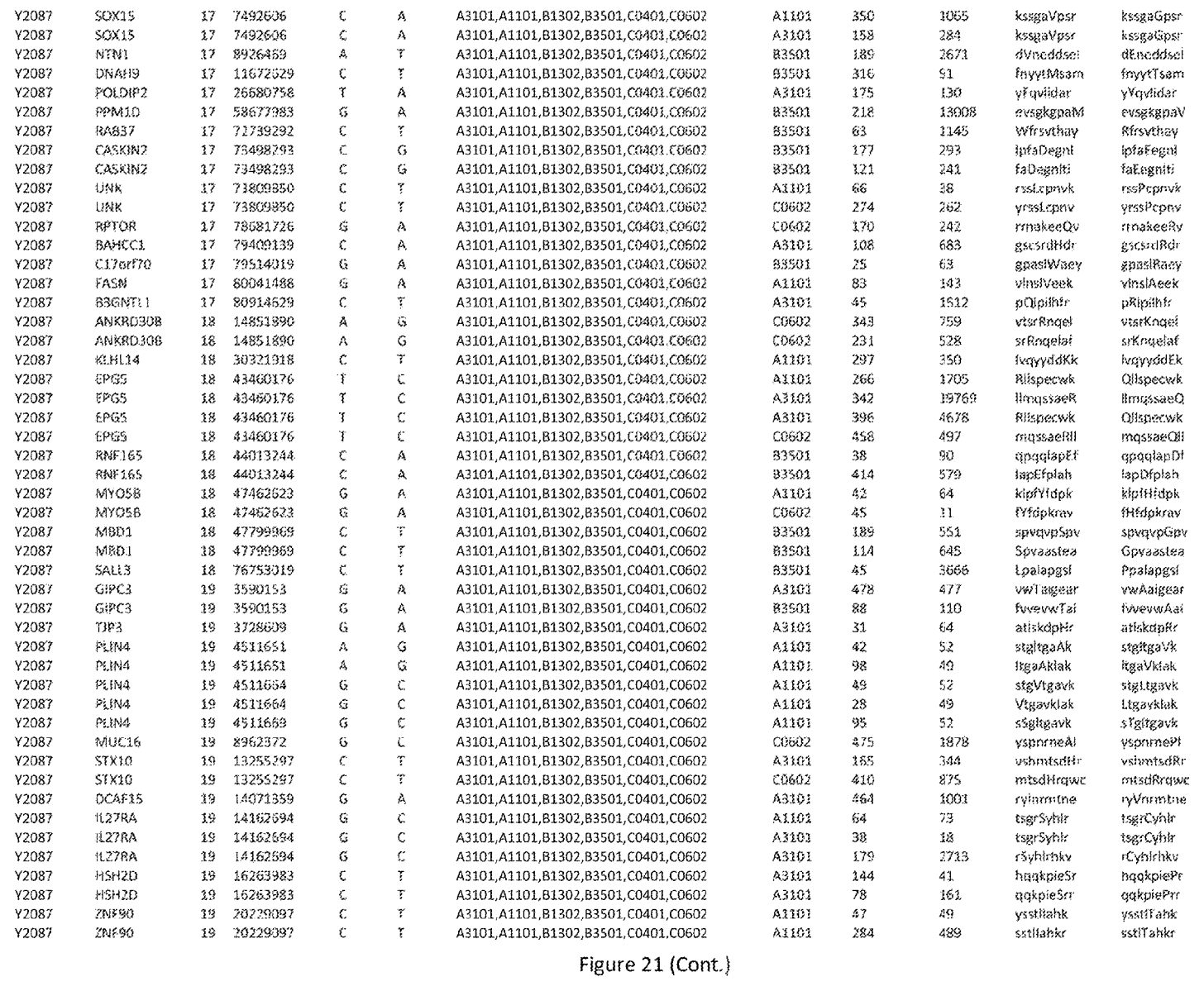
Figure 21:
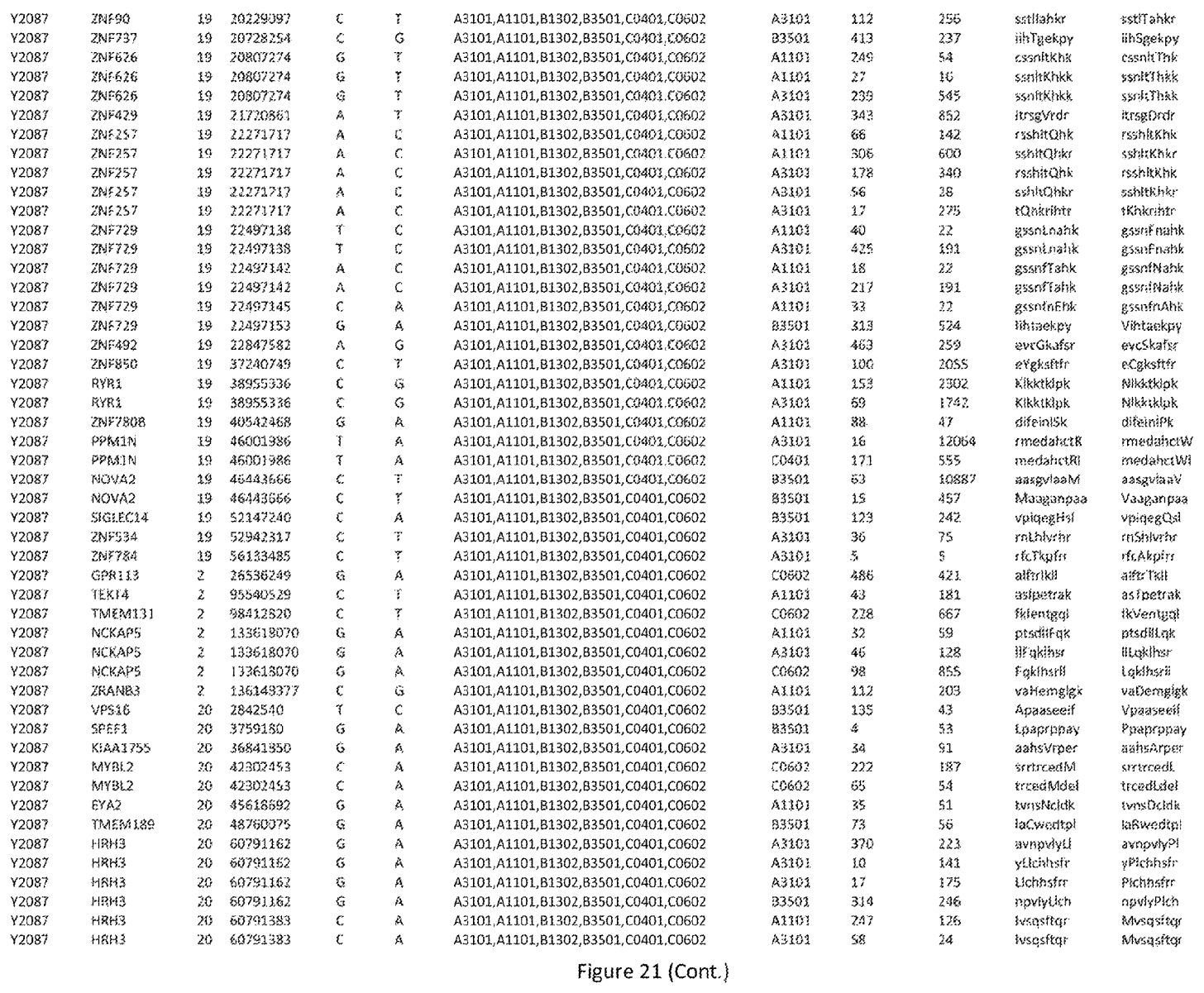
Figure 21:
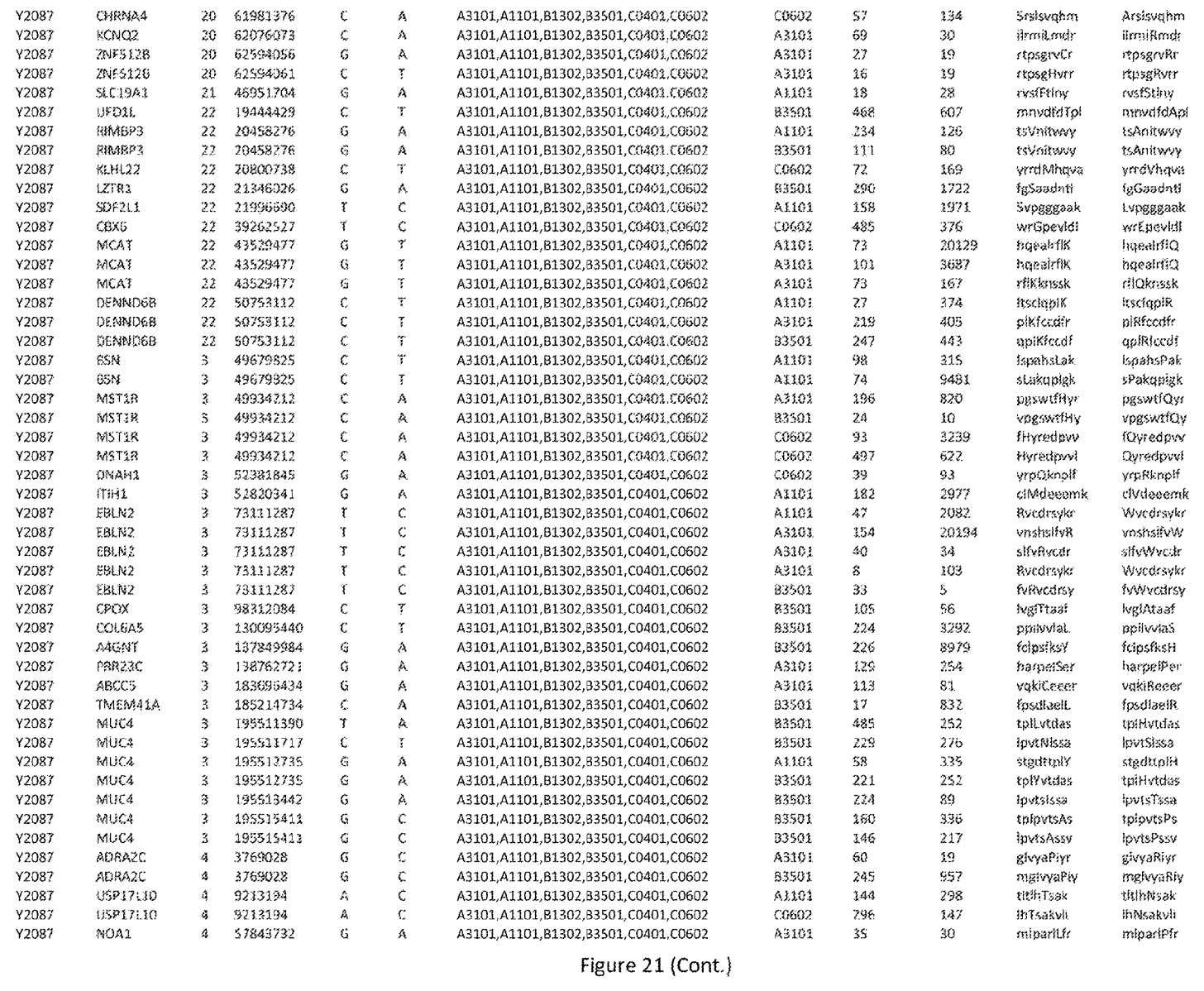
Figure 21:
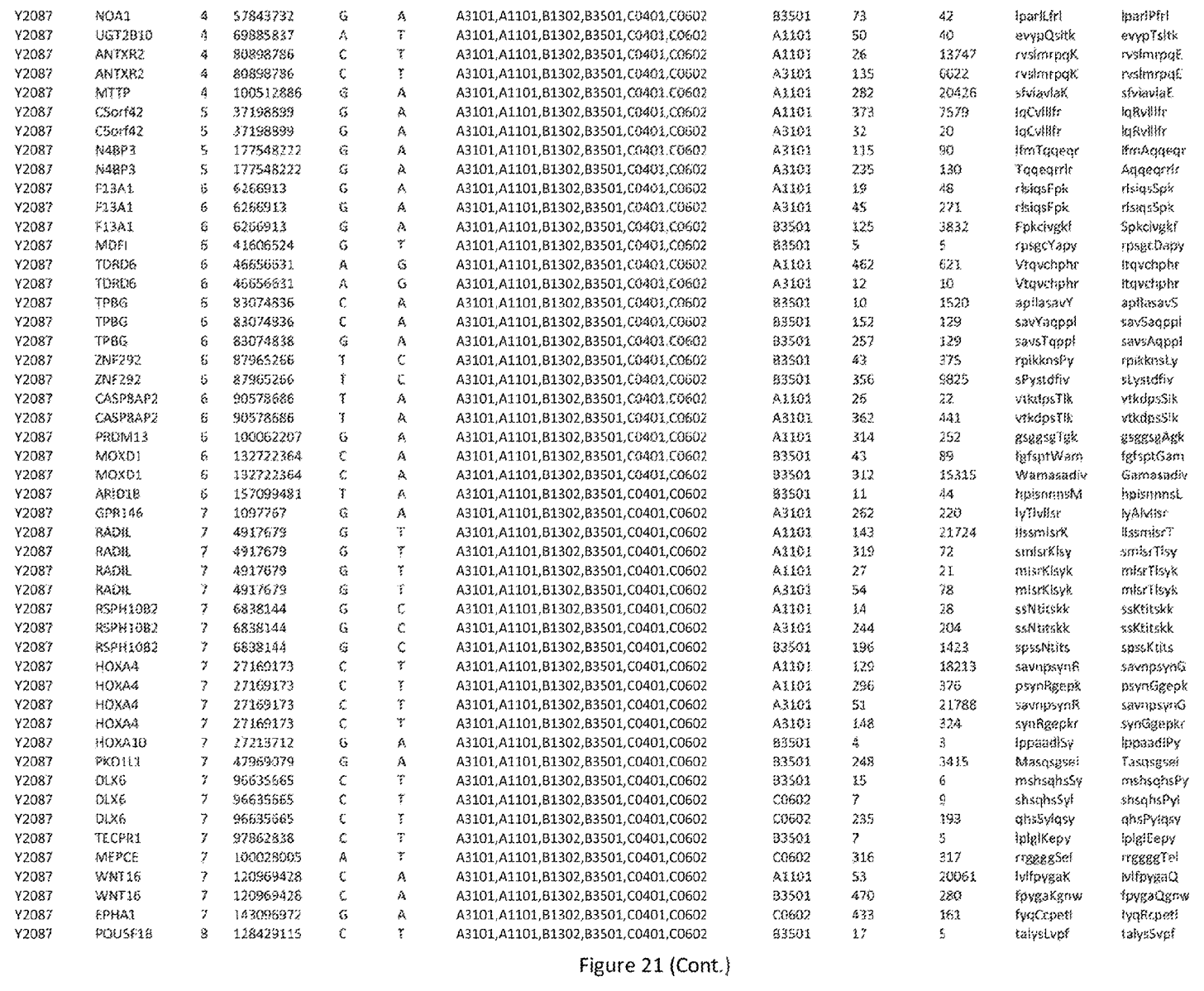
Figure 21:
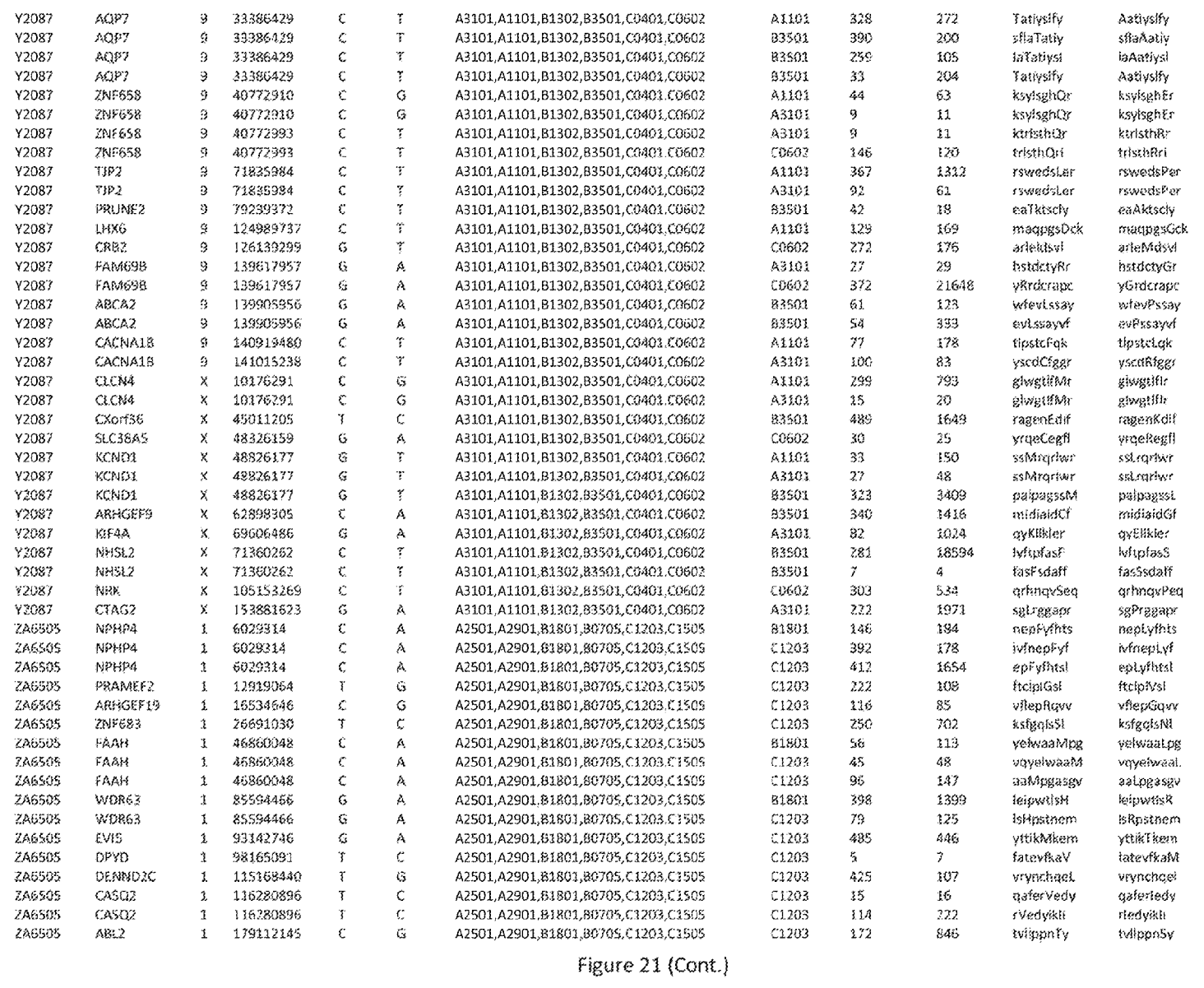
Figure 21:
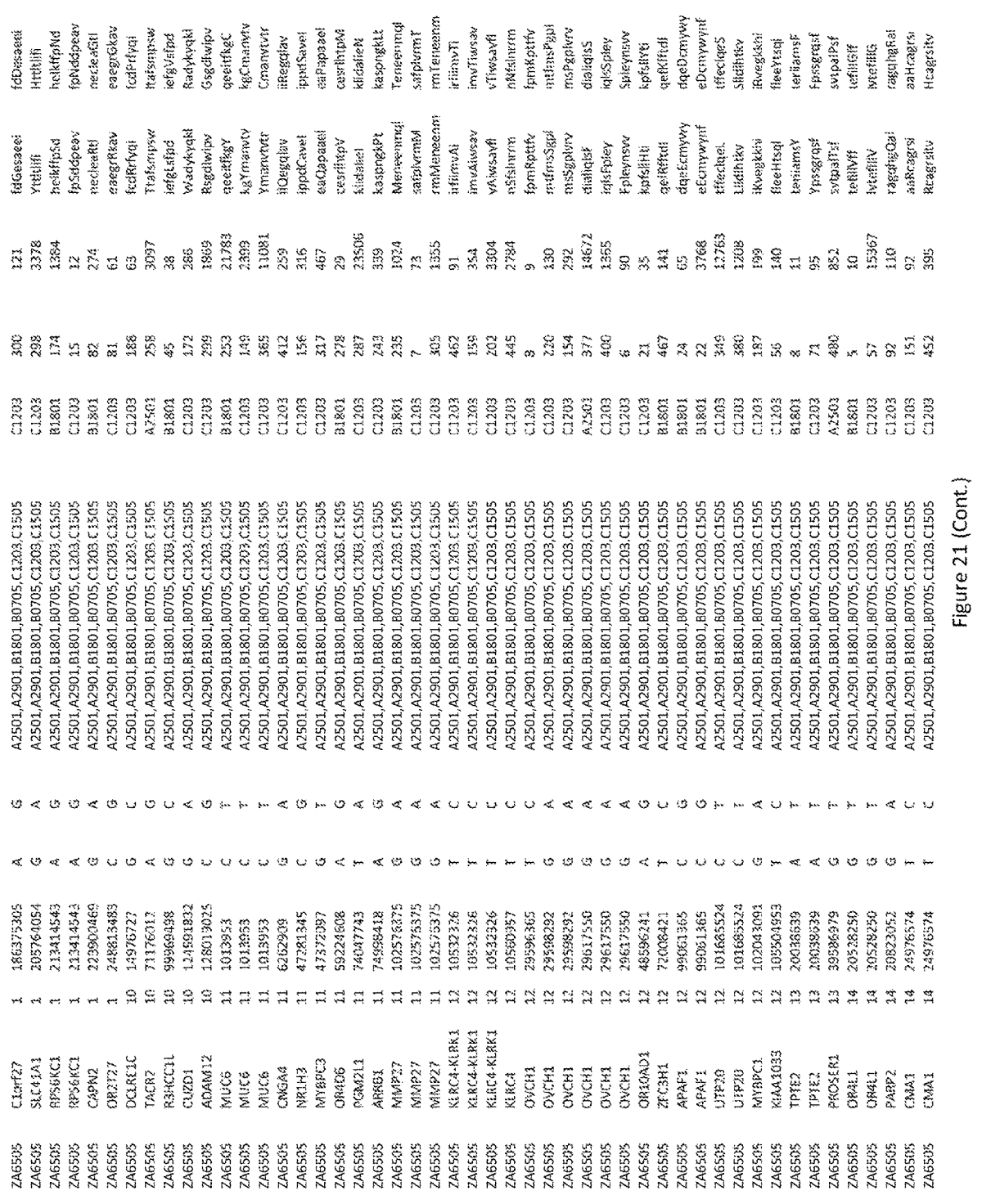
Figure 21:
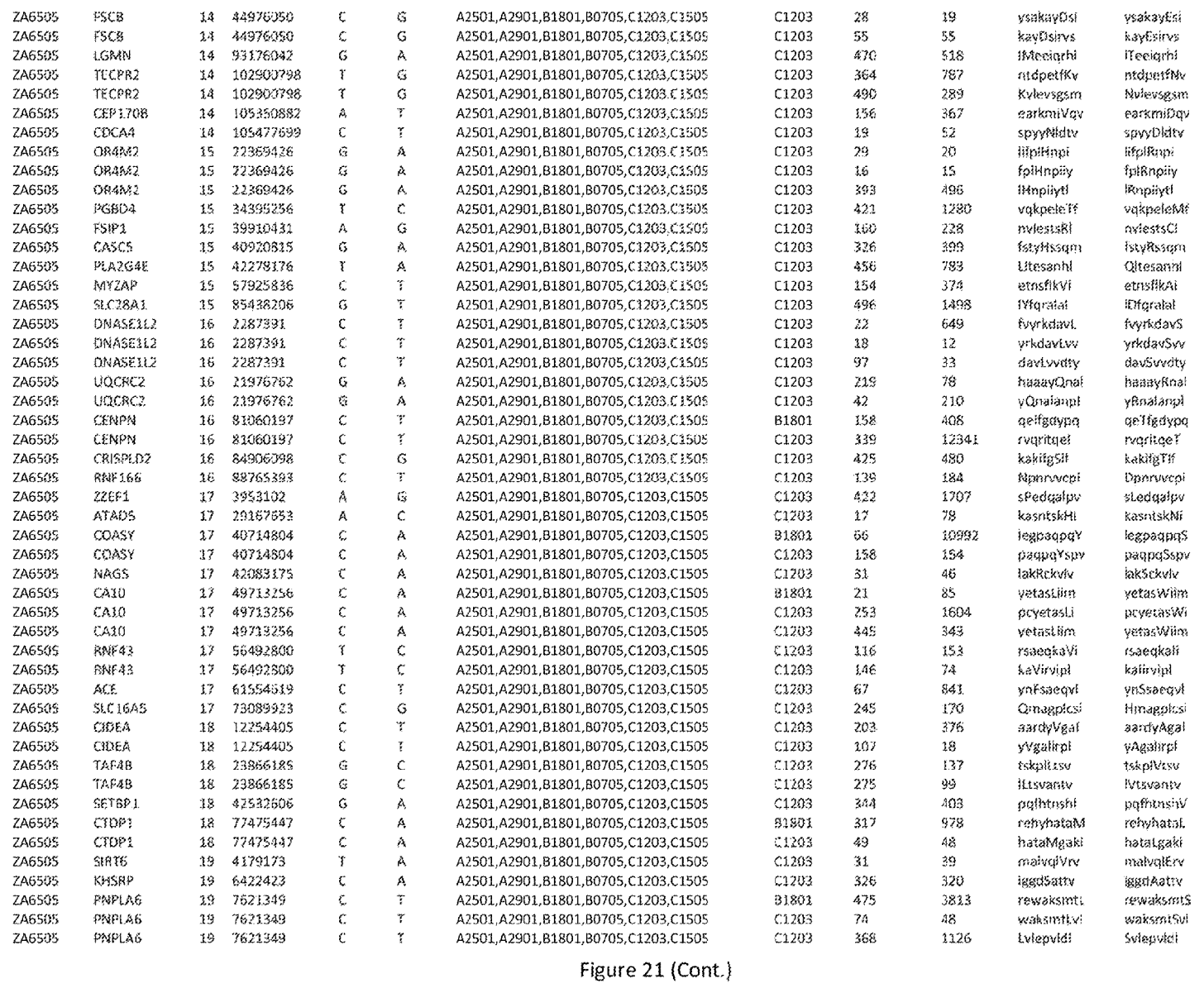
Figure 21:
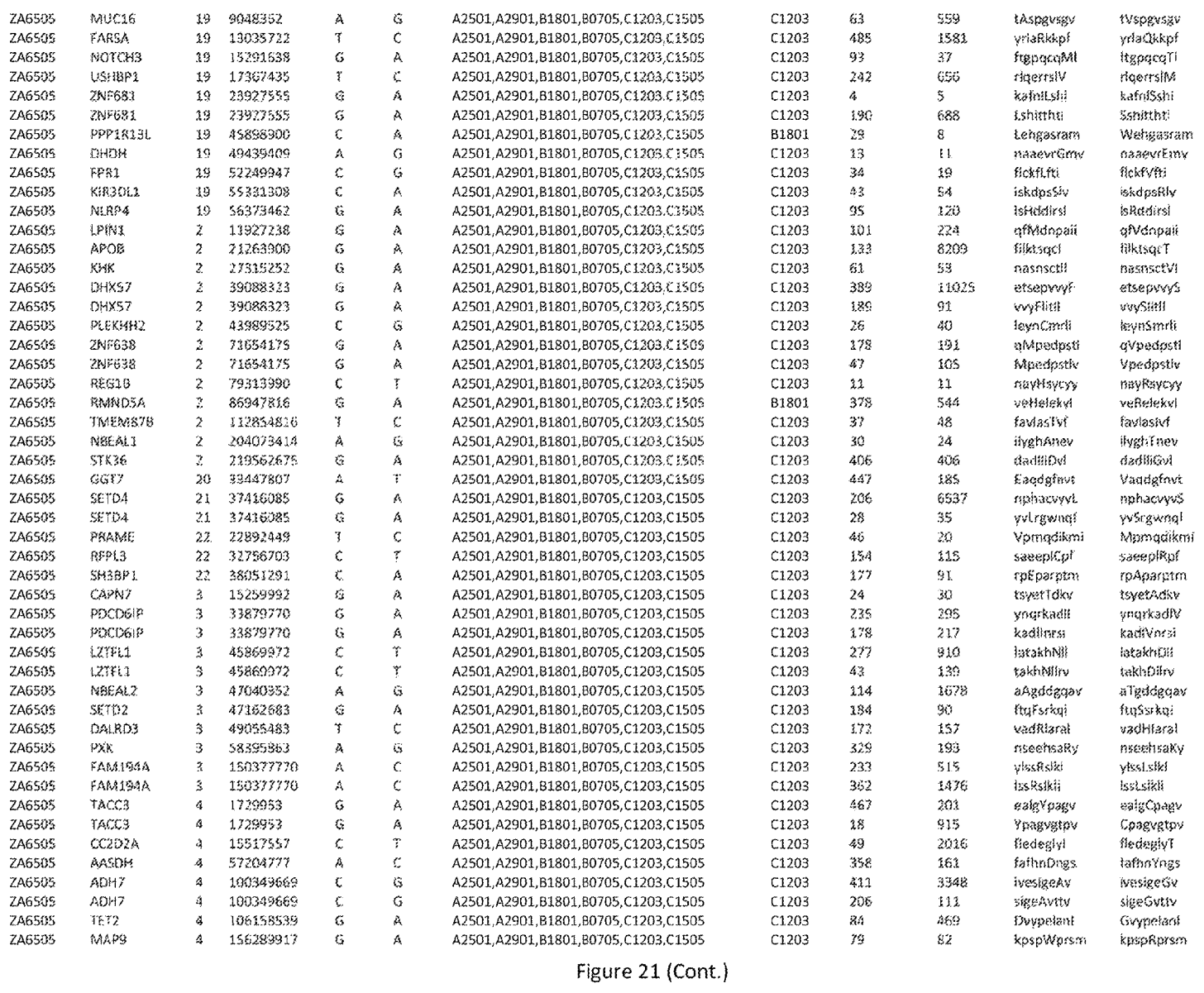
Figure 21:
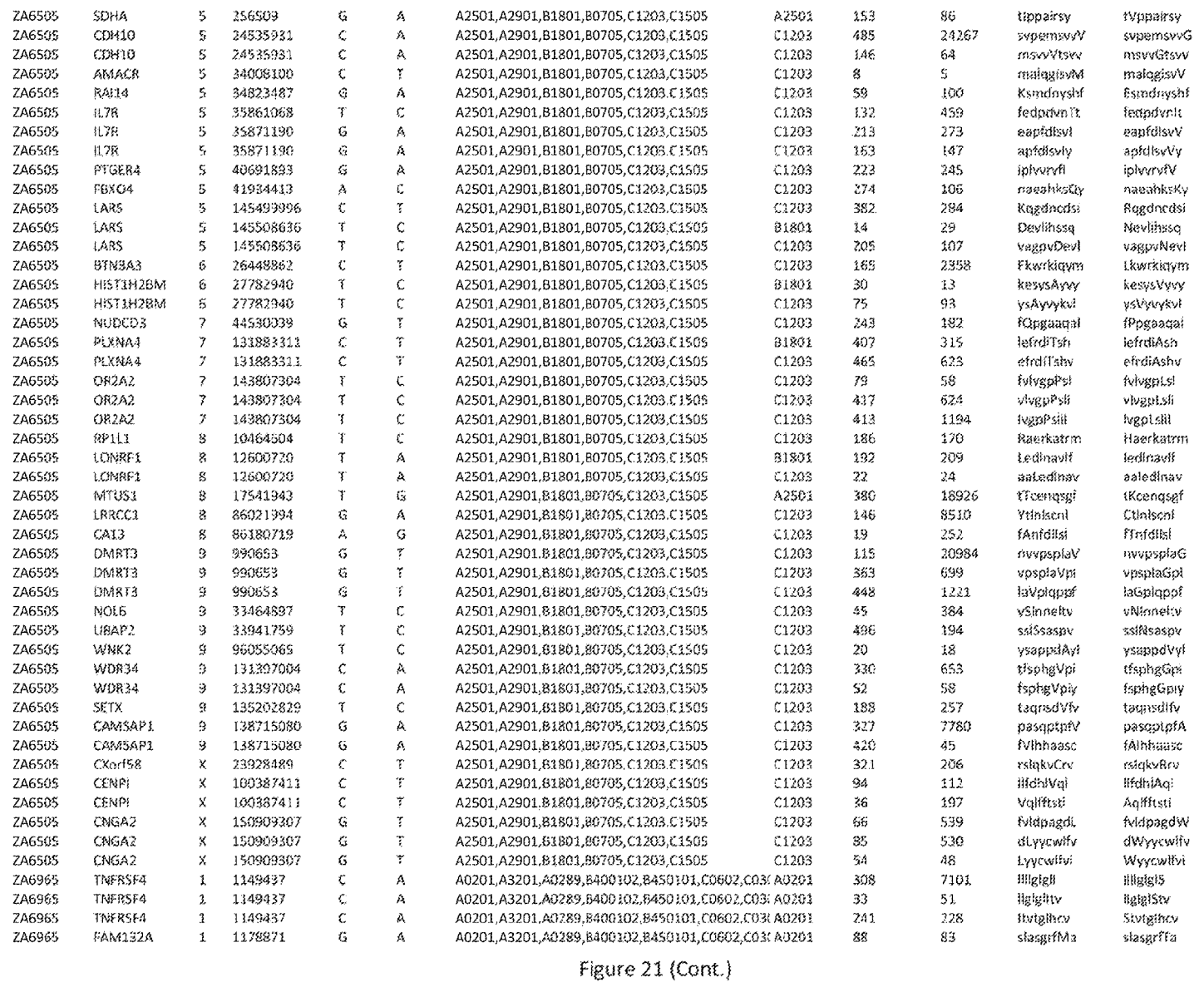
Figure 21:
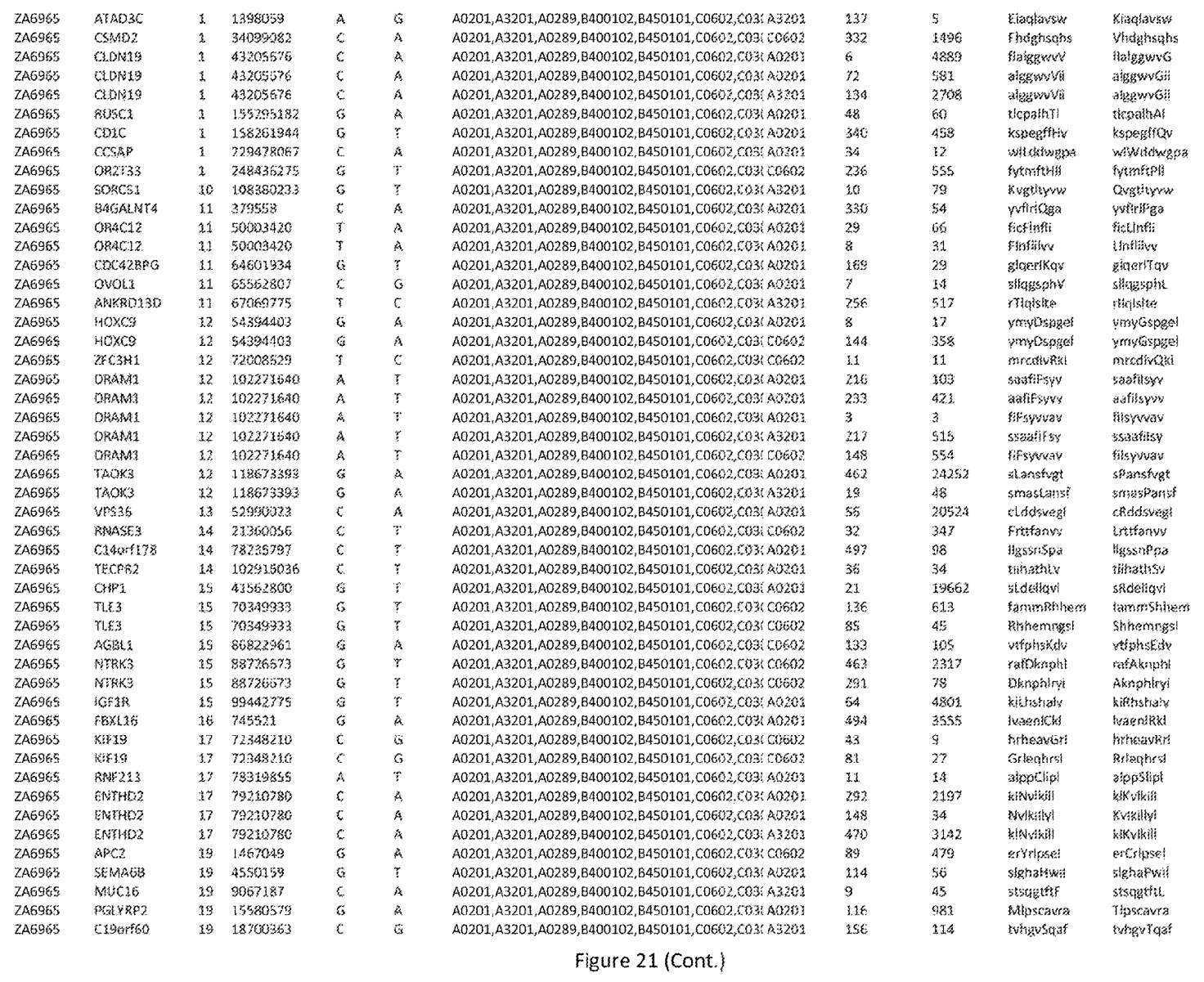
Figure 21:
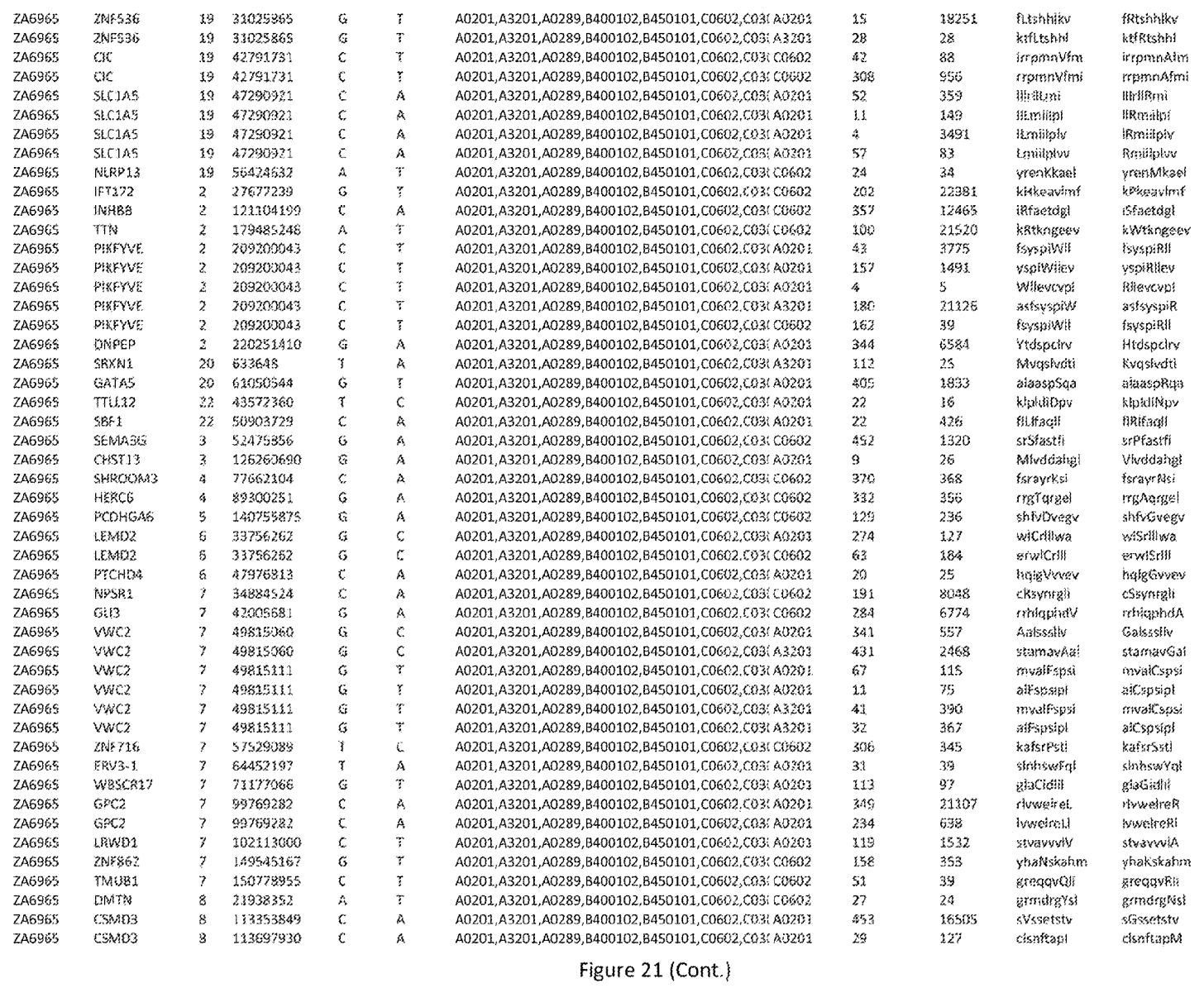

FIG. 21 depicts neoepitope sequences. FIG. 21 includes, among other things, a listing of immunogenic mutations, HLA typesm neoantigens and predicted MHC binding. "Mut" peptides disclosed as SEQ ID NOS 1-5581, respectively, in order of appearance, and "WT" peptides disclosed as SEQ ID NOS 5582-11162, respectively, in order of appearance.

DEFINITIONS

In order for the present invention to be more readily understood, certain terms are defined below. Those skilled in the art will appreciate that definitions for certain terms may be provided elsewhere in the specification, and/or will be clear from context.

Administration: As used herein, the term "administration" refers to the administration of a composition to a subject. Administration may be by any appropriate route. For example, in some embodiments, administration may be bronchial (including by bronchial instillation), buccal, enteral, interdermal, intra-arterial, intradermal, intragastric, intramedullary, intramuscular, intranasal, intraperitoneal, intrathecal, intravenous, intraventricular, mucosal, nasal, oral, rectal, subcutaneous, sublingual, topical, tracheal (including by intratracheal instillation), transdermal, vaginal and vitreal.

Affinity: As is known in the art, "affinity" is a measure of the tightness with a particular ligand binds to its partner. Affinities can be measured in different ways. In some embodiments, affinity is measured by a quantitative assay. In some such embodiments, binding partner concentration may be fixed to be in excess of ligand concentration so as to mimic physiological conditions. Alternatively or additionally, in some embodiments, binding partner concentration and/or ligand concentration may be varied. In some such embodiments, affinity may be compared to a reference under comparable conditions (e.g., concentrations).

Amino acid: As used herein, term "amino acid," in its broadest sense, refers to any compound and/or substance that can be incorporated into a polypeptide chain. In some embodiments, an amino acid has the general structure H2N—C(H)(R)—COOH. In some embodiments, an amino acid is a naturally occurring amino acid. In some embodiments, an amino acid is a synthetic amino acid; in some embodiments, an amino acid is a d-amino acid; in some embodiments, an amino acid is an l-amino acid. "Standard amino acid" refers to any of the twenty standard l-amino acids commonly found in naturally occurring peptides. "Nonstandard amino acid" refers to any amino acid, other than the standard amino acids, regardless of whether it is prepared synthetically or obtained from a natural source. As used herein, "synthetic amino acid" encompasses chemically modified amino acids, including but not limited to salts, amino acid derivatives (such as amides), and/or substitutions. Amino acids, including carboxy- and/or amino-terminal amino acids in peptides, can be modified by methylation, amidation, acetylation, protecting groups, and/or substitution with other chemical groups that can change the peptide's circulating half-life without adversely affecting their activity. Amino acids may participate in a disulfide bond. Amino acids may comprise one or posttranslational modifications, such as association with one or more chemical entities (e.g., methyl groups, acetate groups, acetyl groups, phosphate groups, formyl moieties, isoprenoid groups, sulfate groups, polyethylene glycol moieties, lipid moieties, carbohydrate moieties, biotin moieties, etc.). The term "amino acid" is used interchangeably with "amino acid residue," and may refer to a free amino acid and/or to an amino acid residue of a peptide. It will be apparent from the context in which the term is used whether it refers to a free amino acid or a residue of a peptide.

Antibody agent: As used herein, the term "antibody agent" refers to an agent that specifically binds to a particular antigen. In some embodiments, the term encompasses any polypeptide with immunoglobulin structural elements sufficient to confer specific binding. Suitable antibody agents include, but are not limited to, human antibodies, primatized antibodies, chimeric antibodies, bi-specific antibodies, humanized antibodies, conjugated antibodies (i.e., antibodies conjugated or fused to other proteins, radiolabels, cytotoxins), Small Modular ImmunoP harmaceuticals ("SMIPs™"), single chain antibodies, cameloid antibodies, and antibody fragments. As used herein, the term "antibody agent" also includes intact monoclonal antibodies, polyclonal antibodies, single domain antibodies (e.g., shark single domain antibodies (e.g., IgNAR or fragments thereof)), multispecific antibodies (e.g. bi-specific antibodies) formed from at least two intact antibodies, and antibody fragments so long as they exhibit the desired biological activity. In some embodiments, the term encompasses stapled peptides. In some embodiments, the term encompasses one or more antibody-like binding peptidomimetics. In some embodiments, the term encompasses one or more antibody-like binding scaffold proteins. In come embodiments, the term encompasses monobodies or adnectins. In many embodiments, an antibody agent is or comprises a polypeptide whose amino acid sequence includes one or more structural elements recognized by those skilled in the art as a complementarity determining region (CDR); in some embodiments an antibody agent is or comprises a polypeptide whose amino acid sequence includes at least one CDR (e.g., at least one heavy chain CDR and/or at least one light chain CDR) that is substantially identical to one found in a reference antibody. In some embodiments an included CDR is substantially identical to a reference CDR in that it is either identical in sequence or contains between 1-5 amino acid substitutions as compared with the reference CDR. In some embodiments an included CDR is substantially identical to a reference CDR in that it shows at least 85%, 86%, 87%, 88%, 89%, 90%, 91%, 92%, 93%, 94%, 95%, 96%, 97%, 98%, 99%, or 100% sequence identity with the reference CDR. In some embodiments an included CDR is substantially identical to a reference CDR in that it shows at least 96%, 96%, 97%, 98%, 99%, or 100% sequence identity with the reference CDR. In some embodiments an included CDR is substantially identical to a reference CDR in that at least one amino acid within the included CDR is deleted, added, or substituted as compared with the reference CDR but the included CDR has an amino acid sequence that is otherwise identical with that of the reference CDR. In some embodiments an included CDR is substantially identical to a reference CDR in that 1-5 amino acids within the included CDR are deleted, added, or substituted as compared with the reference CDR but the included CDR has an amino acid sequence that is otherwise identical to the reference CDR. In some embodiments an included CDR is substantially identical to a reference CDR in that at least one amino acid within the included CDR is substituted as compared with the reference CDR but the included CDR has an amino acid sequence that is otherwise identical with that of the reference CDR. In some embodiments an included CDR is substantially identical to a reference CDR in that 1-5 amino acids within the included CDR are deleted, added, or substituted as compared with the reference CDR but the included CDR has an amino acid sequence that is otherwise identical to the reference CDR. In some embodiments, an antibody agent is or comprises a polypeptide whose amino acid sequence includes structural elements recognized by those skilled in the art as an immunoglobulin variable domain. In some embodiments, an antibody agent is a polypeptide protein having a binding domain which is homologous or largely homologous to an immunoglobulin-binding domain.

Antibody polypeptide: As used herein, the terms "antibody polypeptide" or "antibody", or "antigen-binding fragment thereof", which may be used interchangeably, refer to polypeptide(s) capable of binding to an epitope. In some embodiments, an antibody polypeptide is a full-length antibody, and in some embodiments, is less than full length but includes at least one binding site (comprising at least one, and preferably at least two sequences with structure of antibody "variable regions"). In some embodiments, the term "antibody polypeptide" encompasses any protein having a binding domain which is homologous or largely homologous to an immunoglobulin-binding domain. In particular embodiments, "antibody polypeptides" encompasses polypeptides having a binding domain that shows at least 99% identity with an immunoglobulin binding domain. In some embodiments, "antibody polypeptide" is any protein having a binding domain that shows at least 70%, 80%, 85%, 90%, or 95% identity with an immuglobulin binding domain, for example a reference immunoglobulin binding domain. An included "antibody polypeptide" may have an amino acid sequence identical to that of an antibody that is found in a natural source. Antibody polypeptides in accordance with the present invention may be prepared by any available means including, for example, isolation from a natural source or antibody library, recombinant production in or with a host system, chemical synthesis, etc., or combinations thereof. An antibody polypeptide may be monoclonal or polyclonal. An antibody polypeptide may be a member of any immunoglobulin class, including any of the human classes: IgG, IgM, IgA, IgD, and IgE. In certain embodiments, an antibody may be a member of the IgG immunoglobulin class. As used herein, the terms "antibody polypeptide" or "characteristic portion of an antibody" are used interchangeably and refer to any derivative of an antibody that possesses the ability to bind to an epitope of interest. In certain embodiments, the "antibody polypeptide" is an antibody fragment that retains at least a significant portion of the full-length antibody's specific binding ability. Examples of antibody fragments include, but are not limited to, Fab, Fab', F(ab')$_2$, scFv, Fv, dsFv diabody, and Fd fragments. Alternatively or additionally, an antibody fragment may comprise multiple chains that are linked together, for example, by disulfide linkages. In some embodiments, an antibody polypeptide may be a human antibody. In some embodiments, the antibody polypeptides may be a humanized. Humanized antibody polypeptides include may be chimeric immunoglobulins, immunoglobulin chains or antibody polypeptides (such as Fv, Fab, Fab', F(ab')2 or other antigen-binding subsequences of antibodies) that contain minimal sequence derived from non-human immunoglobulin. In general, humanized antibodies are human immunoglobulins (recipient antibody) in which residues from a complementary-determining region (CDR) of the recipient are replaced by residues from a CDR of a non-human species (donor antibody) such as mouse, rat or rabbit having the desired specificity, affinity, and capacity. In particular embodiments, antibody polypeptides for use in accordance with the present invention bind to particular epitopes of on immune checkpoint molecules.

Antigen: An "antigen" is a molecule or entity to which an antibody binds. In some embodiments, an antigen is or comprises a polypeptide or portion thereof. In some embodiments, an antigen is a portion of an infectious agent that is recognized by antibodies. In some embodiments, an antigen is an agent that elicits an immune response; and/or (ii) an agent that is bound by a T cell receptor (e.g., when presented by an WIC molecule) or to an antibody (e.g., produced by a B cell) when exposed or administered to an organism. In some embodiments, an antigen elicits a humoral response (e.g., including production of antigen-specific antibodies) in an organism; alternatively or additionally, in some embodiments, an antigen elicits a cellular response (e.g., involving T-cells whose receptors specifically interact with the antigen) in an organism. It will be appreciated by those skilled in the art that a particular antigen may elicit an immune response in one or several members of a target organism (e.g., mice, rabbits, primates, humans), but not in all members of the target organism species. In some embodiments, an antigen elicits an immune response in at least about 25%, 30%, 35%, 40%, 45%, 50%, 55%, 60%, 65%, 70%, 75%, 80%, 85%, 90%, 91%, 92%, 93%, 94%, 95%, 96%, 97%, 98%, 99% of the members of a target organism species. In some embodiments, an antigen binds to an antibody and/or T cell receptor, and may or may not induce a particular physiological response in an organism. In some embodiments, for example, an antigen may bind to an antibody and/or to a T cell receptor in vitro, whether or not such an interaction occurs in vivo. In general, an antigen may be or include any chemical entity such as, for example, a small molecule, a nucleic acid, a polypeptide, a carbohydrate, a lipid, a polymer [in some embodiments other than a biologic polymer (e.g., other than a nucleic acid or amino acid polymer)] etc. In some embodiments, an antigen is or comprises a polypeptide. In some embodiments, an antigen is or comprises a glycan. Those of ordinary skill in the art will appreciate that, in general, an antigen may be provided in isolated or pure form, or alternatively may be provided in crude form (e.g., together with other materials, for example in an extract such as a cellular extract or other relatively crude preparation of an antigen-containing source). In some embodiments, antigens utilized in accordance with the present invention are provided in a crude form. In some embodiments, an antigen is or comprises a recombinant antigen.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Burden: The term "burden" as used herein, for example in reference to mutation burden or neoantigen burden, refers to the number or rate (e.g., of mutations or neoantigens) in a sample or cohort, in some embodiments relative to that observed in an appropriate reference sample or cohort.

Combination therapy: The term "combination therapy", as used herein, refers to those situations in which two or more different pharmaceutical agents are administered in overlapping regimens so that the subject is simultaneously exposed to both agents. When used in combination therapy, two or more different agents may be administered simultaneously or separately. This administration in combination can include simultaneous administration of the two or more agents in the same dosage form, simultaneous administration in separate dosage forms, and separate administration. That is, two or more agents can be formulated together in the same dosage form and administered simultaneously. Alternatively, two or more agents can be simultaneously administered, wherein the agents are present in separate formulations. In another alternative, a first agent can be administered just followed by one or more additional agents. In the separate administration protocol, two or more agents may be administered a few minutes apart, or a few hours apart, or a few days apart.

Comparable: The term "comparable" is used herein to describe two (or more) sets of conditions, circumstances, individuals, or populations that are sufficiently similar to one another to permit comparison of results obtained or phenomena observed. In some embodiments, comparable sets of conditions, circumstances, individuals, or populations are characterized by a plurality of substantially identical features and one or a small number of varied features. Those of ordinary skill in the art will appreciate that sets of circumstances, individuals, or populations are comparable to one another when characterized by a sufficient number and type of substantially identical features to warrant a reasonable conclusion that differences in results obtained or phenomena observed under or with different sets of circumstances, individuals, or populations are caused by or indicative of the variation in those features that are varied. Those skilled in the art will appreciate that relative language used herein (e.g., enhanced, activated, reduced, inhibited, etc) will typically refer to comparisons made under comparable conditions.

Consensus sequence: As used herein, the term "consensus sequence" refers to a core sequence that elicits or drives a physiological phenomenon (e.g., an immune response). It is to be understood by those of skill in the art that a a cancer cell that shares a "consensus sequence" with an antigen of an infectious agent shares a portion of amino acid sequence that affects the binding affinity of the antigen to an MHC molecule (either directly or allosterically), and/or facilitates recognition by T cell receptors. In some embodiments, a consensus sequence is a tetrapeptide. In some embodiments, a consensus sequence is a nonapeptide. In some embodiments, a consensus sequence is betwene four and nine amino acids in length. In some embodiments, a consesnsus sequence is greater than nine amino acids in length.

Diagnostic information: As used herein, diagnostic information or information for use in diagnosis is any information that is useful in determining whether a patient has a disease or condition and/or in classifying the disease or condition into a phenotypic category or any category having significance with regard to prognosis of the disease or condition, or likely response to treatment (either treatment in general or any particular treatment) of the disease or condition. Similarly, diagnosis refers to providing any type of diagnostic information, including, but not limited to, whether a subject is likely to have a disease or condition (such as cancer), state, staging or characteristic of the disease or condition as manifested in the subject, information related to the nature or classification of a tumor, information related to prognosis and/or information useful in selecting an appropriate treatment. Selection of treatment may include the choice of a particular therapeutic (e.g., chemotherapeutic) agent or other treatment modality such as surgery, radiation, etc., a choice about whether to withhold or deliver therapy, a choice relating to dosing regimen (e.g., frequency or level of one or more doses of a particular therapeutic agent or combination of therapeutic agents), etc.

Dosing regimen: A "dosing regimen" (or "therapeutic regimen"), as that term is used herein, is a set of unit doses (typically more than one) that are administered individually to a subject, typically separated by periods of time. In some embodiments, a given therapeutic agent has a recommended dosing regimen, which may involve one or more doses. In some embodiments, a dosing regimen comprises a plurality of doses each of which are separated from one another by a time period of the same length; in some embodiments, a dosing regimen comprises a plurality of doses and at least two different time periods separating individual doses. In some embodiments, a dosing regimen is or has been correlated with a desired therapeutic outcome, when administered across a population of patients.

Durable clinical benefit: As used herein, the term "durable clinical benefit" (DCB), has its art-understood meaning, referring to a clinical benefit that lasts for a relevant period of time. In some embodiments, such a clinical benefit is or comprises reduction in tumor size, increase in progession free survival, increase in overall survival, decrease in overall tumor burden, decrease in the symptoms caused by tumor growth such as pain, organ failure, bleeding, damage to the skeletal system, and other related sequelae of metastatic cancer and combinations thereof. In some embodiments, the relevant period of time is at least 1 month, 2 months, 3 months, 4 months, 5 months, 6 months, 7 months, 8 months, 9 months, 10 months, 11 months, 1 year, 2 years, 3 years, 4 years, 5 years, or longer. In some particular emodiments, the relevant period of time is 6 months.

Favorable response: As used herein, the term "favorable response" refers to a reduction in frequency and/or intensity of one or more symptoms, reduction in tumor burden, full or partial remission, or other improvement in disease pathophysiology. Symptoms are reduced when one or more symptoms of a particular disease, disorder or condition is reduced in magnitude (e.g., intensity, severity, etc.) and/or frequency. For purposes of clarity, a delay in the onset of a particular symptom is considered one form of reducing the frequency of that symptom. Many cancer patients with smaller tumors have no symptoms. It is not intended that the present invention be limited only to cases where the symptoms are eliminated. The present invention specifically contemplates treatment such that one or more symptoms is/are reduced (and the condition of the subject is thereby "improved"), albeit not completely eliminated. In some embodiments, a favorable response is established when a particular therapeutic regimen shows a statistically significant effect when administered across a relevant population; demonstration of a particular result in a specific individual may not be required. Thus, in some embodiments, a particular therapeutic regimen is determined to have a favorable response when its administration is correlated with a relevant desired effect.

Homology: As used herein, the term "homology" refers to the overall relatedness between polymeric molecules, e.g., between nucleic acid molecules (e.g., DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% similar.

Identity: As used herein, the term "identity" refers to the overall relatedness between polymeric molecules, e.g., between nucleic acid molecules (e.g., DNA molecules and/or RNA molecules) and/or between polypeptide molecules. Calculation of the percent identity of two nucleic acid sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or substantially 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix.

Immune checkpoint modulator: As used herein, the term "immune checkpoint modulator" refers to an agent that interacts directly or indirectly with an immune checkpoint. In some embodiments, an immune checkpoint modulator increases an immune effector response (e.g., cytotoxic T cell response), for example by stimulating a positive signal for T cell activation. In some embodiments, an immune checkpoint modulator increases an immune effector response (e.g., cytotoxic T cell response), for example by inhibiting a negative signal for T cell activation (e.g. disinhibition). In some embodiments, an immune checkpoint modulator interferes with a signal for T cell anergy. In some embodiments, an immune checkpoint modulator reduces, removes, or prevents immune tolerance to one or more antigens.

Long Term Benefit: In general, the term "long term benefit" refers to a desirable clinical outcome, e.g., observed after administration of a particular treatment or therapy of interest, that is maintained for a clinically relevant period of time. To give but one example, in some embodiments, a long term benefit of cancer therapy is or comprises (1) no evidence of disease ("NED", for example upon radiographic assessment) and/or (2) stable or decreased volume of diseases. In some embodiments, a clinically relevant period of time is at least 1 month, at least 2 months, at least 3 months, at least 4 months, at least 5 months or more. In some embodiments, a clinically relevant period of time is at least six months. In some embodiments, a clinically relevant period of time is at least 1 year.

Marker: A marker, as used herein, refers to an agent whose presence or level is a characteristic of a particular tumor or metastatic disease thereof. For example, in some embodiments, the term refers to a gene expression product that is characteristic of a particular tumor, tumor subclass, stage of tumor, etc. Alternatively or additionally, in some embodiments, a presence or level of a particular marker correlates with activity (or activity level) of a particular signaling pathway, for example that may be characteristic of a particular class of tumors. The statistical significance of the presence or absence of a marker may vary depending upon the particular marker. In some embodiments, detection of a marker is highly specific in that it reflects a high probability that the tumor is of a particular subclass. Such specificity may come at the cost of sensitivity (i.e., a negative result may occur even if the tumor is a tumor that would be expected to express the marker). Conversely, markers with a high degree of sensitivity may be less specific that those with lower sensitivity. According to the present invention a useful marker need not distinguish tumors of a particular subclass with 100% accuracy.

Modulator: The term "modulator" is used to refer to an entity whose presence in a system in which an activity of interest is observed correlates with a change in level and/or nature of that activity as compared with that observed under otherwise comparable conditions when the modulator is absent. In some embodiments, a modulator is an activator, in that activity is increased in its presence as compared with that observed under otherwise comparable conditions when the modulator is absent. In some embodiments, a modulator is an inhibitor, in that activity is reduced in its presence as compared with otherwise comparable conditions when the modulator is absent. In some embodiments, a modulator interacts directly with a target entity whose activity is of interest. In some embodiments, a modulator interacts indirectly (i.e., directly with an intermediate agent that interacts with the target entity) with a target entity whose activity is of interest. In some embodiments, a modulator affects level of a target entity of interest; alternatively or additionally, in some embodiments, a modulator affects activity of a target entity of interest without affecting level of the target entity. In some embodiments, a modulator affects both level and activity of a target entity of interest, so that an observed difference in activity is not entirely explained by or commensurate with an observed difference in level.

Mutation: As used herein, the term "mutation" refers to permanent change in the DNA sequence that makes up a gene. In some embodiments, mutations range in size from a single DNA building block (DNA base) to a large segment of a chromosome. In some embodiments, mutations can include missense mutations, frameshift mutations, duplications, insertions, nonsense mutation, deletions and repeat expansions. In some embodiments, a missense mutation is a change in one DNA base pair that results in the substitution of one amino acid for another in the protein made by a gene. In some embodiments, a nonsense mutation is also a change in one DNA base pair. Instead of substituting one amino acid for another, however, the altered DNA sequence prematurely signals the cell to stop building a protein. In some embodiments, an insertion changes the number of DNA bases in a gene by adding a piece of DNA. In some embodiments, a deletion changes the number of DNA bases by removing a piece of DNA. In some embodiments, small deletions may remove one or a few base pairs within a gene, while larger deletions can remove an entire gene or several neighboring genes. In some embodiments, a duplication consists of a piece of DNA that is abnormally copied one or more times.

In some embodiments, frameshift mutations occur when the addition or loss of DNA bases changes a gene's reading frame. A reading frame consists of groups of 3 bases that each code for one amino acid. In some embodiments, a frameshift mutation shifts the grouping of these bases and changes the code for amino acids. In some embodiments, insertions, deletions, and duplications can all be frameshift mutations. In some embodiments, a repeat expansion is another type of mutation. In some embodiments, nucleotide repeats are short DNA sequences that are repeated a number of times in a row. For example, a trinucleotide repeat is made up of 3-base-pair sequences, and a tetranucleotide repeat is made up of 4-base-pair sequences. In some embodiments, a repeat expansion is a mutation that increases the number of times that the short DNA sequence is repeated.

Neoepitope: A "neoepitope" is understood in the art to refer to an epitope that emerges or develops in a subject after exposure to or occurrence of a particular event (e.g., development or progression of a particular disease, disorder or condition, e.g., infection, cancer, stage of cancer, etc). As used herein, a neoepitope is one whose presence and/or level is correlated with exposure to or occurrence of the event. In some embodiments, a neoepitope is one that triggers an immune response against cells that express it (e.g., at a relevant level). In some embodiments, a neoepitope is one that triggers an immune response that kills or otherwise destroys cells that express it (e.g., at a relevant level). In some embodiments, a relevant event that triggers a neoepitope is or comprises somatic mutation in a cell. In some embodiments, a neoepitope is not expressed in non-cancer cells to a level and/or in a manner that triggers and/or supports an immune response (e.g., an immune response sufficient to target cancer cells expressing the neoepitope). In some embodiments, a neoepitope is a neoantigen.

No Benefit: As used herein, the phrase "no benefit" is used to refer to absence of detectable clinical benefit (e.g., in response to administration of a particular therapy or treatment of interest). In some embodiments, absence of clinical benefit refers to absence of statistically significant change in any particular symptom or characteristic of a particular disease, disorder, or condition. In some embodiments, absence of clinical benefit refers to a change in one or more symptoms or characteristics of a disease, disorder, or condition, that lasts for only a short period of time such as, for example, less than about 6 months, less than about 5 months, less than about 4 months, less than about 3 months, less than about 2 months, less than about 1 month, or less. In some embodiments, no benefit refers to no durable benefit.

Objective Response: As used herein, the phrase "objective response" refers to size reduction of a cancerous mass by a defined amount. In some embodiments, the cancerous mass is a tumor. In some embodiments, confirmed objective response is response confirmed at least four (4) weeks after treatment.

Objective Response Rate: As used herein, the term "objective response rate" ("ORR") has its art-understood meaning referring to the proportion of patients with tumor size reduction of a predefined amount and for a minimum time period. In some embodiments, response duration usually measured from the time of initial response until documented tumor progression. In some embodiments, ORR involves the sum of partial responses plus complete responses.

Patient: As used herein, the term "patient" or "subject" refers to any organism to which a provided composition is or may be administered, e.g., for experimental, diagnostic, prophylactic, cosmetic, and/or therapeutic purposes. Typical patients include animals (e.g., mammals such as mice, rats, rabbits, non-human primates, and/or humans). In some embodiments, a patient is a human. In some embodiments, a patient is suffering from or susceptible to one or more disorders or conditions. In some embodiments, a patient displays one or more symptoms of a disorder or condition. In some embodiments, a patient has been diagnosed with one or more disorders or conditions. In some embodiments, the disorder or condition is or includes cancer, or presence of one or more tumors. In some embodiments, the disorder or condition is metastatic cancer.

Polypeptide: As used herein, a "polypeptide", generally speaking, is a string of at least two amino acids attached to one another by a peptide bond. In some embodiments, a polypeptide may include at least 3-5 amino acids, each of which is attached to others by way of at least one peptide bond. Those of ordinary skill in the art will appreciate that polypeptides sometimes include "non-natural" amino acids or other entities that nonetheless are capable of integrating into a polypeptide chain, optionally.

Prognostic and predictive information: As used herein, the terms prognostic and predictive information are used interchangeably to refer to any information that may be used to indicate any aspect of the course of a disease or condition either in the absence or presence of treatment. Such information may include, but is not limited to, the average life expectancy of a patient, the likelihood that a patient will survive for a given amount of time (e.g., 6 months, 1 year, 5 years, etc.), the likelihood that a patient will be cured of a disease, the likelihood that a patient's disease will respond to a particular therapy (wherein response may be defined in any of a variety of ways). Prognostic and predictive information are included within the broad category of diagnostic information.

Progression Free Survival: As used herein, the term "progression free survival" (PFS) has its art-understood meaning relating to the length of time during and after the treatment of a disease, such as cancer, that a patient lives with the disease but it does not get worse. In some embodiments, measuring the progression-free survival is utilized as an assessment of how well a new treatment works. In some embodiments, PFS is determined in a randomized clinical trial; in some such embodiments, PFS refers to time from randomization until objective tumor progression and/or death.

Protein: As used herein, the term "protein" refers to a polypeptide (i.e., a string of at least two amino acids linked to one another by peptide bonds). Proteins may include moieties other than amino acids (e.g., may be glycoproteins, proteoglycans, etc.) and/or may be otherwise processed or modified. Those of ordinary skill in the art will appreciate that a "protein" can be a complete polypeptide chain as produced by a cell (with or without a signal sequence), or can be a characteristic portion thereof. Those of ordinary skill will appreciate that a protein can sometimes include more than one polypeptide chain, for example linked by one or more disulfide bonds or associated by other means. Polypeptides may contain L-amino acids, D-amino acids, or both and may contain any of a variety of amino acid modifications or analogs known in the art. Useful modifications include, e.g., terminal acetylation, amidation, methylation, etc. In some embodiments, proteins may comprise natural amino acids, non-natural amino acids, synthetic amino acids, and combinations thereof. The term "peptide" is generally used to refer to a polypeptide having a length of less than about 100 amino acids, less than about 50 amino acids, less than 20 amino acids, or less than 10 amino acids.

Reference: Those of skill in the art will appreciate that, in many embodiments described herein, a determined value or characteristic of interest is compared with an appropriate reference. In some embodiments, a reference value or characteristic is one determined for a comparable cohort, individual, population, or sample. In some embodiments, a reference value or characteristic is tested and/or determined substantially simultaneously with the testing or determination of the characteristic or value of interest. In some embodiments, a reference characteristic or value is or comprises a historical reference, optionally embodied in a tangible medium. Typically, as would be understood by those skilled in the art, a reference value or characteristic is determined under conditions comparable to those utilized to determine or analyze the characteristic or value of interest.

Response: As used herein, the term "response" may refer to an alteration in a subject's condition that occurs as a result of or correlates with treatment. In some embodiments, a response is or comprises a beneficial response. In some embodiments, a beneficial response may include stabilization of the condition (e.g., prevention or delay of deterioration expected or typically observed to occur absent the treatment), amelioration (e.g., reduction in frequency and/or intensity) of one or more symptoms of the condition, and/or improvement in the prospects for cure of the condition, etc. In some embodiments, "response" may refer to response of an organism, an organ, a tissue, a cell, or a cell component or in vitro system. In some embodiments, a response is or comprises a clinical response. In some embodiments, presence, extent, and/or nature of response may be measured and/or characterized according to particular criteria; in some embodiments, such criteria may include clinical criteria and/or objective criteria. In some embodiments, techniques for assessing response may include, but are not limited to, clinical examination, positron emission tomography, chest X-ray CT scan, MRI, ultrasound, endoscopy, laparoscopy, presence or level of a particular marker in a sample, cytology, and/or histology. Where a response of interest is or comprises response of a tumor to therapy, those of ordinary skill will be aware of a variety of established techniques for assessing such response, including, for example, for determining tumor burden, tumor size, tumor stage, etc. For example, certain technologies for assessing response of solid tumors to treatment are discussed in Therasse et. al., "New guidelines to evaluate the response to treatment in solid tumors", European Organization for Research and Treatment of Cancer, National Cancer Institute of the United States, National Cancer Institute of Canada, J. Natl. Cancer Inst., 2000, 92(3):205-216. Those of ordinary skill in the art will be aware of, and/or will appreciate in light of the present disclosure, strategies for determining particular response criteria for individual tumors, tumor types, patient populations or cohorts, etc, as well as for determining appropriate references therefor.

Sample: As used herein, the term "sample" typically refers to a biological sample obtained or derived from a source of interest, as described herein. In some embodiments, a source of interest comprises an organism, such as an animal or human. In some embodiments, a biological sample is or comprises biological tissue or fluid. In some embodiments, a biological sample may be or comprise bone marrow; blood; blood cells; ascites; tissue or fine needle biopsy samples; cell-containing body fluids; free floating nucleic acids; sputum; saliva; urine; cerebrospinal fluid, peritoneal fluid; pleural fluid; feces; lymph; gynecological fluids; skin swabs; vaginal swabs; oral swabs; nasal swabs; washings or lavages such as a ductal lavages or broncheoalveolar lavages; aspirates; scrapings; bone marrow specimens; tissue biopsy specimens; surgical specimens; feces, other body fluids, secretions, and/or excretions; and/or cells therefrom, etc. In some embodiments, a biological sample is or comprises cells obtained from an individual. In some embodiments, obtained cells are or include cells from an individual from whom the sample is obtained. In some embodiments, a sample is a "primary sample" obtained directly from a source of interest by any appropriate means. For example, in some embodiments, a primary biological sample is obtained by methods selected from the group consisting of biopsy (e.g., fine needle aspiration or tissue biopsy), surgery, collection of body fluid (e.g., blood, lymph, feces etc.), etc. In some embodiments, as will be clear from context, the term "sample" refers to a preparation that is obtained by processing (e.g., by removing one or more components of and/or by adding one or more agents to) a primary sample. For example, filtering using a semi-permeable membrane. Such a "processed sample" may comprise, for example nucleic acids or proteins extracted from a sample or obtained by subjecting a primary sample to techniques such as amplification or reverse transcription of mRNA, isolation and/or purification of certain components, etc.

Specific binding: As used herein, the terms "specific binding" or "specific for" or "specific to" refer to an interaction (typically non-covalent) between a target entity (e.g., a target protein or polypeptide) and a binding agent (e.g., an antibody, such as a provided antibody). As will be understood by those of ordinary skill, an interaction is considered to be "specific" if it is favored in the presence of alternative interactions. In many embodiments, an interaction is typically dependent upon the presence of a particular structural feature of the target molecule such as an antigenic determinant or epitope recognized by the binding molecule. For example, if an antibody is specific for epitope A, the presence of a polypeptide containing epitope A or the presence of free unlabeled A in a reaction containing both free labeled A and the antibody thereto, will reduce the amount of labeled A that binds to the antibody. It is to be understood that specificity need not be absolute. For example, it is well known in the art that numerous antibodies cross-react with other epitopes in addition to those present in the target molecule. Such cross-reactivity may be acceptable depending upon the application for which the antibody is to be used. In particular embodiments, an antibody specific for receptor tyrosine kinases has less than 10% cross-reactivity with receptor tyrosine kinase bound to protease inhibitors (e.g., ACT). One of ordinary skill in the art will be able to select antibodies having a sufficient degree of specificity to perform appropriately in any given application (e.g., for detection of a target molecule, for therapeutic purposes, etc.). Specificity may be evaluated in the context of additional factors such as the affinity of the binding molecule for the target molecule versus the affinity of the binding molecule for other targets (e.g., competitors).

Stage of cancer: As used herein, the term "stage of cancer" refers to a qualitative or quantitative assessment of the level of advancement of a cancer. Criteria used to determine the stage of a cancer include, but are not limited to, the size of the tumor and the extent of metastases (e.g., localized or distant).

Subject: As used herein, the term "subject" or "patient" refers to any organism upon which embodiments of the invention may be used or administered, e.g., for experimental, diagnostic, prophylactic, and/or therapeutic purposes.

Typical subjects include animals (e.g., mammals such as mice, rats, rabbits, non-human primates, and humans; insects; worms; etc.).

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Suffering from: An individual who is "suffering from" a disease, disorder, or condition (e.g., a cancer) has been diagnosed with and/or exhibits one or more symptoms of the disease, disorder, or condition. In some embodiments, an individual who is suffering from cancer has cancer, but does not display any symptoms of cancer and/or has not been diagnosed with a cancer.

Susceptible to: An individual who is "susceptible to" a disease, disorder, or condition (e.g., cancer) is at risk for developing the disease, disorder, or condition. In some embodiments, an individual who is susceptible to a disease, disorder, or condition does not display any symptoms of the disease, disorder, or condition. In some embodiments, an individual who is susceptible to a disease, disorder, or condition has not been diagnosed with the disease, disorder, and/or condition. In some embodiments, an individual who is susceptible to a disease, disorder, or condition is an individual who displays conditions associated with development of the disease, disorder, or condition. In some embodiments, a risk of developing a disease, disorder, and/or condition is a population-based risk.

Target cell or target tissue: As used herein, the terms "target cell" or "target tissue" refer to any cell, tissue, or organism that is affected by a condition described herein and to be treated, or any cell, tissue, or organism in which a protein involved in a condition described herein is expressed. In some embodiments, target cells, target tissues, or target organisms include those cells, tissues, or organisms in which there is a detectable amount of immune checkpoint signaling and/or activity. In some embodiments, target cells, target tissues, or target organisms include those cells, tissues or organisms that display a disease-associated pathology, symptom, or feature.

Therapeutic regimen: As used herein, the term "therapeutic regimen" refers to any method used to partially or completely alleviate, ameliorate, relieve, inhibit, prevent, delay onset of, reduce severity of and/or reduce incidence of one or more symptoms or features of a particular disease, disorder, and/or condition. It may include a treatment or series of treatments designed to achieve a particular effect, e.g., reduction or elimination of a detrimental condition or disease such as cancer. The treatment may include administration of one or more compounds either simultaneously, sequentially or at different times, for the same or different amounts of time. Alternatively, or additionally, the treatment may include exposure to radiation, chemotherapeutic agents, hormone therapy, or surgery. In addition, a "treatment regimen" may include genetic methods such as gene therapy, gene ablation or other methods known to reduce expression of a particular gene or translation of a gene-derived mRNA.

Therapeutic agent: As used herein, the phrase "therapeutic agent" refers to any agent that, when administered to a subject, has a therapeutic effect and/or elicits a desired biological and/or pharmacological effect.

Therapeutically effective amount: As used herein, the term "therapeutically effective amount" refers to an amount of an agent (e.g., an immune checkpoint modulator) that confers a therapeutic effect on the treated subject, at a reasonable benefit/risk ratio applicable to any medical treatment. The therapeutic effect may be objective (i.e., measurable by some test or marker) or subjective (i.e., subject gives an indication of or feels an effect). In particular, the "therapeutically effective amount" refers to an amount of a therapeutic agent or composition effective to treat, ameliorate, or prevent a desired disease or condition, or to exhibit a detectable therapeutic or preventative effect, such as by ameliorating symptoms associated with the disease, preventing or delaying the onset of the disease, and/or also lessening the severity or frequency of symptoms of the disease. A therapeutically effective amount is commonly administered in a dosing regimen that may comprise multiple unit doses. For any particular therapeutic agent, a therapeutically effective amount (and/or an appropriate unit dose within an effective dosing regimen) may vary, for example, depending on route of administration, on combination with other pharmaceutical agents. Also, the specific therapeutically effective amount (and/or unit dose) for any particular patient may depend upon a variety of factors including the disorder being treated and the severity of the disorder; the activity of the specific pharmaceutical agent employed; the specific composition employed; the age, body weight, general health, sex and diet of the subject; the time of administration, route of administration, and/or rate of excretion or metabolism of the specific fusion protein employed; the duration of the treatment; and like factors as is well known in the medical arts.

Treatment: As used herein, the term "treatment" (also "treat" or "treating") refers to any administration of a substance (e.g., provided compositions) that partially or completely alleviates, ameliorates, relieves, inhibits, delays onset of, reduces severity of, and/or reduces incidence of one or more symptoms, features, and/or causes of a particular disease, disorder, and/or condition (e.g., cancer). Such treatment may be of a subject who does not exhibit signs of the relevant disease, disorder and/or condition and/or of a subject who exhibits only early signs of the disease, disorder, and/or condition. Alternatively or additionally, such treatment may be of a subject who exhibits one or more established signs of the relevant disease, disorder and/or condition. In some embodiments, treatment may be of a subject who has been diagnosed as suffering from the relevant disease, disorder, and/or condition. In some embodiments, treatment may be of a subject known to have one or more susceptibility factors that are statistically correlated with increased risk of development of the relevant disease, disorder, and/or condition.

Wild-type: As used herein, the term "wild-type" has its art-understood meaning that refers to an entity having a structure and/or activity as found in nature in a "normal" (as contrasted with mutant, diseased, altered, etc.) state or context. Those of ordinary skill in the art will appreciate that wild-type genes and polypeptides often exist in multiple different forms (e.g., alleles).

DETAILED DESCRIPTION OF CERTAIN EMBODIMENTS

The present invention encompasses the discovery of particular signatures and/or characteristics that can be detected in certain tumors or tumor samples and that predict or correlate with responsiveness to immune checkpoint modulator therapy. For example, among other things, the present disclosure demonstrates that a high mutational load can correlate with such responsiveness. The present disclosure also particularly demonstrates that presence (e.g., number and/or rate) and/or identity of somatic neoepitopes (e.g., which may result from tumor mutations) can contribute to, and therefore may correlate with, such responsiveness. Among other things, the present disclosure defines certain mutation and/or neoepitope characteristics of relevant tumors that correlate with and/or can be used to predict responsiveness to immune checkpoint modulator therapy. The present disclosure also provides technologies for defining and/or detecting certain mutation "signatures" useful in predicting and/or characterizing such responsiveness.

Furthermore, the overall number and/or rate of mutation and/or of neoepitopes in cancer cells can be predictive of clinical response to immunotherapy, and particularly to immune checkpoint modulator therapy. Thus, in accordance with the present invention, those individuals whose tumors show high mutation burden and/or high neoepitope burden are predisposed to benefit from immunotherapy as described herein compared to those individuals with reltaively lower such burdens.

Without wishing to be bound by any particular theory, we note that the present disclosure demonstrates, among other things, that neoepitopes in cancer cells can be associated with increased binding affinity to MHC class I molecules and/or with improved recognition by cytotoxic T cells. In some embodiments, neoepitopes useful in predicting responsiveness to therapy as described herein (e.g., useful for inclusion in a "signature" that can be detected or analyzed in assessing likelihood of response) are those that in fact show increased binding affinity to MHC class I molecules and/or improved recognition by cytotoxic T cells, for example relative to a parent protein that is otherwise identical but lacks the neoepitope.

In general, the present disclosure relates to characterizing tumor responsiveness to immunotherapy, and particularly to immune checkpoint modulator therapy. In some embodiments, such therapy involves blockade of programmed cell death 1 (PD-1). In some particular embodiments, such therapy involves treatement with an agent that interferes with an interaction involving PD-1 (e.g., with PD-L1). In some embodiments, such therapy involves administration of an antibody agent that specifically interacts with PD-1 or with PD-L1. In some embodiments, such therapy involves administration of one or more of nivolumab (BMS-936558, MDX-1106, ONO-4538, a fully human Immunoglobulin G4 (IgG4) monoclonal PD-1 antibody), pembrolizumab (MK-3475, a humanized monoclonal IgG4 anti-PD-1 antibody), BMS-936559 (a fully human IgG4 PD-L1 antibody), MPDL3280A (a humanized engineered IgG1 monoclonal PD-L1 antibody) and/or MEDI4736 (a humanized engineered IgG1 monoclonal PD-L1 antibody).

The present invention provides, among other things, technologies for defining, characterizing, and/or detecting burden (e.g., number, level, and/or rate) of somatic mutations and/or neoepitopes present in cancer cells and/or for defining, characterizing, and/or detecting particular mutation and/or neoepitope "signatures" that predict responsiveness to immunotherapy, and particularly to immune checkpoint modulator therapy. In some emodiments, the present invention provides methods and/or reagents for identifying cancer patients that are likely to respond favorably to treatment with immunotherapy (e.g., with an immune checkpoint modulator) and/or for selecting patients to receive such immunotherapy. Alternatively or additionally, the present invention provides methods and/or reagents for treating patients with an immune checkpoint modulator that have been identified to have cancer harboring a particular mutation burden, neoepitope burden, and/or mutation or neoepitope signature as described herein.

The present invention defines and provides tools and kits for detecting or determining whether a particular cancer patient does or does not have the relevant mutational landscape or signature for responding to immunotherapy (e.g., PD-1 blockade). The present invention demonstrates that certain particular mutational landscapes or signatures are more useful and effective in predicting responsiveness.

The present disclosure demonstrates that high mutational loads can predict responsiveness of cancers to immunotherapy. Furthermore, the disclosure also teaches that high neoepitope loads can predict responsiveness of cancers to immunotherapy. Moreover, the present disclosure demonstrates that particular mutational and/or neoepitope signatures can predict responsiveness of cancers to immunotherapy. Specifically, the present disclosure establishes that signatures including information from DNA repair genes and/or signal transduction genes can predict responsiveness of cancers to immunotherapy. The present disclosure further establishes that signatures that, alternatively or additionally, include characteristics of the established molecular smoking signature, can predict responsiveness of cancers to immunotherapy.

Cancer Cell Mutability

Acquired (or somatic) mutations can occur in the DNA of cells at some time during an individual's life. These changes can be caused by environmental factors such as ultraviolet radiation from the sun, carcinogens in chemicals or cigarette smoke, or can occur if a mistake is made during DNA replication. Cancer cells from cancers such as lung cancer or melanoma, which are often the result of chronic exposure to environmental factor or mutagens, often possess multiple mutations of varying types.

Within tumor types there is a large variability in mutation loads, ranging from tens to thousands of mutations with a cancer cell. In analyzing the tumors of non small cell lung carcinoma (NSCLC) patients, smokers have a much greater mutation burden compared to never-smokers. The present disclosure shows, that in those cancers that are responsive to immunotherapy (e.g., PD-1 blockade), higher mutation loads correlated with better response to immune checkpoint regulators. In some embodiments, highly mutable cancers are more susceptible to attack from the immune system.

Mutations of certain genes correlate with higher (hyper) levels of mutations in cancer cells. The present disclosure demonstrates that mutations in genes associated with DNA repair correlated with cancer cells possessing higher numbers of mutations.

Mutational Load and Susceptibility to Immune System

Among other things, the present disclosure demonstrates a that high mutation load can predict clinical efficacy of immunotherapy treatment for certain cancers. The present disclosure establishes that, in certain cases, individuals with higher somatic mutation loads are more likely to respond positively to immunotherapy than individuals with significantly lower mutation burdens. The present disclosure demonstrates that, for certain cancers, patients with high numbers of mutations are more likely to benefit from treatment with immune checkpoint modulators than those patients with lower mutation loads. In some embodiments, patients with higher numbers of somatic mutations respond better to PD-1 (programmed cell death 1) blockade than those patients with significantly lower overall mutations. In some embodiments, individuals with high numbers of mutations respond better to treatment with anti-PD-1 antibodies than those individuals with low numbers of mutations. In some embodiments, the overall number of mutations has a greater correlation with positive response to immunotherapy than the specific mutational signatures.

In some embodiments, the type of somatic mutation correlates with response to treatment. For example, the present disclosure teaches that individuals with a lower transition to transversion ratio (Ti/Tv) also experienced greater likelihood of positive response to immunotherapy.

Defined Signatures

The present disclosure encompasses the insight that meaningful limits can be imposed on mutational analysis of cancer cells and, moreover, that use of such limits surprisingly defines and/or provides signature formats that effectively predict responsiveness to treatment. In some embodiments, the \ mutation signatures as described herein correlate with and/or predict response to immunotherapy (e.g., PD-1 blockade). In some embodiments, the genes that are mutated (for example, DNA repair) as well as the exact type of mutation (for example, transversions rather than transitions) correlate with and/or are predictive of positive response to immunotherapy. Moreover, the present disclosure demonstrates that such signatures can be detected and effectively utilized to predict tumor responsiveness.

In some embodiments, as described herein, the present disclosure provides technologies for defining mutation signatures that predict responsiveness to immunotherapy, and particularly to immune checkpoint modulator therapy. In some embodiments, the present disclosure defines one or more characteristics or attributes of useful signatures. In some embodiments, the present disclosure describes and/or establishes effective use of such signatures in predicting therapeutic responsiveness.

Use of Signatures

The present disclosure demonstrates that mutational landscape of particular tumors can predict the likelihood of clinical benefit from immunotherapy (e.g., PD-1 blockade). The disclosure also teaches that high mutation load can predict likelihood of positive response to immunotherapy. Furthermore, the nature of the somatic mutations present can predict response to immunotherapy. As demonstrated herein, in some embodiments, individuals with neoepitope signatures consistent with mutations of genes associated with DNA repair and signaling (e.g., KRAS signaling) also correlated with a positive outcome for immune checkpoint modulation.

The present dislcosure particularly demonstrates, surprisingly, that the established "smoking signature" can be effectively utilized to predict responsiveness of certain tumors to immunotherapy, and particularly to immune checkpoint modulator therapy (e.g., PD-1 blockade). In some embodiments, individuals possessing (or whose tumor(s) possess) one or more features of the molecular smoking signature and suffering from a smoking-related cancer are more likely to repond to immunotherapy than are non-smoking individuals and/or individuals that do not posess (or whose tumor(s) do not possess) the one or more features.

Cancer Types

The present disclosure demonstrates that in those cancers that respond to immunotherapy (e.g., immune checkpoint blockade), the tumor mutational landscape of the patient can predict with clinical efficacy. In some embodiments, cancer types to which the present disclosure applied include one or more of lung cancer (e.g., small cell or non-small-cell carcinoma ("NSCLC"), bladder cancer, renal carcinoma, head and neck cancers, and melanoma respond to immunotherapy. In some embodiments, lung cancer reponds to PD-1 blockade. In some embodiments, expression of PD-L1 is an indicator of positive response to therapy.

In some embodiments, smoking related cancers are more likely to respond to immunotherapy treatment. The present disclosure demonstrates that those individuals possessing (or whose tumor(s) possess) one or more features or characteristics of the established molecular smoking signature are more likely to respond to immunotherapy treatment. In particular, among other things, the present disclosure establishes that, for those individuals suffering from NSCLC, those with the smoking signature experienced greater clinical benefit from treatment with PD-1 blockade than their non-smoker counterparts.

In some embodiments, a cancer cell comprising a neoepitope is selected from a carcinoma, sarcoma, melanoma, myeloma, leukemia, or lymphoma. In some embodiments, a cancer cell comprising a neoepitope is a melanoma. In some embodiments, a cancer cell comprising a neoepitope is a non-small-cell lung carcinoma.

Relevant Therapeutic Modalities

Teachings of the present disclosure predict responsiveness to immunomodulatory therapeutic modalities or regimens, and particularly to therapeutic modalities or regimens targeting immune checkpoint regulators. The present disclosure demonstrates the mutational landscape of tumors correlates with responsiveness to immune checkpoint regulators. In some embodiments, high somatic mutation load correlates with an increased likelihood of clinical efficacy from immune checkpoint regultors for those cancers responsive to immunotherapy (e.g., PD-1 blockade). In some embodiments, such therapy involves blockade of programmed cell death 1 (PD-1). In some particular embodiments, such therapy involves treatement with an agent that interferes with an interaction involving PD-1 (e.g., with PD-L1). In some embodiments, such therapy involves administration of an antibody agent that specifically interacts with PD-1 or with PD-L1. In some embodiments, such therapy involves administration of one or more of nivolumab (BMS-936558, MDX-1106, ONO-4538, a fully human Immunoglobulin G4 (IgG4) monoclonal PD-1 antibody), pembrolizumab (MK-3475, a humanized monoclonal IgG4 anti-PD-1 antibody), BMS-936559 (a fully human IgG4 PD-L1 antibody), MPDL3280A (a humanized engineered IgG1 monoclonal PD-L1 antibody) and/or MEDI4736 (a humanized engineered IgG1 monoclonal PD-L1 antibody).

Somatic Mutations

Somatic mutations comprise DNA alterations in non-germline cells and commonly occur in cancer cells. It has been discovered herein that certain somatic mutations in cancer cells result in the expression of neoepitopes, that in some embodiments transition a stretch of amino acids from being recognized as "self" to "non-self". According to the present invention, a cancer cell harboring a "non-self" antigen is likely to elicit an immune response against the cancer cell. Immune responses against cancer cells can be enhanced by an immune checkpoint modulator. The present invention teaches that cancers expressing neoepitopes may be more responsive to therapy with immune checkpoint modulator. Among other things, the present invention provides strategies for improving cancer therapy by permitting identification and/or selection of particular patients to receive (or avoid) therapy. The present invention also provides technologies for defining neoeptiopes, or sets thereof, whose presence is indicative of a particular clinical outcome of interest (e.g., responsiveness to therapy, for example with a particular immune checkpoint modulator and/or risk of developing a particular undesirable side effect of therapy). The present invention defines and/or permits definition of one or more neoepitope "signatures" associated with beneficial (or undesirable) response to immune checkpoint modulator therapy.

In some embodiments, a somatic mutation results in a neoantigen or neoepitope. Among other things, the present disclosure demonstrates the existence of neoepitopes, arising from somatic mutation, whose presence is associated with a particular response to immune checkpoint modulator therapy. In some embodiments, high numbers of neoepitopes are associated with a positive response to immunotherapy. In some embodiments, a neoepitope is or comprises a tetrapeptide, for example that contributes to increased binding affinity to WIC Class I molecules and/or recognition by cells of the immune system (i.e. T cells) as "non-self". In some embodiments, a neoepitope shares a consensus sequence with an antigen from an infectious agent.

In some embodiments, a neoepitope signature of interest in accordance with the present invention is or comprises a neoepitope or set thereof whose presence in a tumor sample correlates with a particular clinical outcome. In some embodiments, neoepitopes of genes associated with DNA repair correlate with a positive response to immune checkpoint modulation. In some embodiments, neoepitopes of genes associated with signal transduction correlate with a positive response to immune checkpoint therapy. In some embodiments, the present disclosure provides technologies for defining and/or detecting neoepitopes, and particulary those relevant to immune checkpoint modulator therapy.

Among other things, the present disclosure demonstrates definition of neoepitopes and neoepitope signatures associated with a particular response or response feature (e.g., responsiveness to therapy or risk of side effect) of immune checkpoint modulator therapy. In the particular Examples presented herein, such definition is achieved by comparing genetic sequence information from a first plurality of tumor samples, which first plurality contains samples that share a common response feature to immune checkpoint modulator therapy, with that obtained from a second plurality of tumor samples, which second plurality contains samples that do not share the common response feature but are otherwise comparable to those of the first set, so that the comparison defines genetic sequence elements whose presence is associated or correlates with the common response feature. The present disclosure specifically demonstrates that increased mutational burden can correlate with a response feature (e.g., with responsiveness to therapy), but also demonstrates that such increased mutational burden alone may not be sufficient to predict the response feature. The present disclosure demonstrates that, when such somatic mutation generates neoepitopes, a useful neoeptiope signature associated with the response feature can be defined. The present disclosure provides specific technologies for defining and utilizing such signatures.

Immune Checkpoint Modulation

Immune checkpoints refer to inhibitory pathways of the immune system that are responsible for maintaining self-tolerance and modulating the duration and amplitude of physiological immune responses.

Certain cancer cells thrive by taking advantage of immune checkpoint pathways as a major mechanism of immune resistance, particularly with respect to T cells that are specific for tumor antigens. For example, certain cancer cells may overexpress one or more immune checkpoint proteins responsible for inhibiting a cytotoxic T cell response. Thus, immune checkpoint modulators may be administered to overcome the inhibitory signals and permit and/or augment an immune attack against cancer cells. Immune checkpoint modulators may facilitate immune cell responses against cancer cells by decreasing, inhibiting, or abrogating signaling by negative immune response regulators (e.g. CTLA4), or may stimulate or enhance signaling of positive regulators of immune response (e.g. CD28).

Immunotherapy agents targeted to immune checkpoint modulators may be administered to encourage immune attack targeting cancer cells. Immunotherapy agents may be or include antibody agents that target (e.g., are specific specific for) immune checkpoint modulators. Examples of immunotherapy agents include antibody agents targeting one or more of CTLA-4, PD-1, PD-L1, GITR, OX40, LAG-3, KIR, TIM-3, CD28, CD40, and CD137.

Specific examples of antibody agents may include monoclonal antibodies. Certain monoclonal antibodies targeting immune checkpoint modulators are available. For instance, ipilumimab targets CTLA-4; tremelimumab targets CTLA-4; pembrolizumab targets PD-1, etc.

Detection of Mutations and/or Neoepitopes

Cancers may be screened to detect mutations and/or neoepitopes (e.g., to detect mutation load/burden and/or neoepitope load/burden, and/or to detect a particular signature) as described herein using any of a variety of known technologies. In some embodiments, particular mutations or neoepitopes, or expression thereof, is/are detected at the nucleic acid level (e.g., in DNA or RNA). In some embodiments, such mutations or neopeitopes, or expression thereof, is detected at the protein level (e.g., in a sample comprising polypeptides from cancer cells, which sample may be or comprise polypeptide complexes or other higher order structures including but not limited to cells, tissues, or organs).

In some particular embodiments, detection involves nucleic acid sequencing. In some embodiments, detection involves whole exome sequencing. In some embodiments, detection involves immunoassay. In some embodiments, detection involves use of amicroarray. In some embodiments, detection involves massively parallel exome sequencing sequencing. In some embodiments, mutations and/or neoepitopes may be detected by genome sequencing. In some embodiments, detection involves RNA sequencing. In some embodiments, detection involves standard DNA or RNA sequencing. In some embodiments, detection involves mass spectrometry.

In some embodiments, detection involves next generation sequencing (DNA and/or RNA). In some embodiments, detection involves genome sequencing, genome resequencing, targeted sequencing panels, transcriptome profiling (RNA-Seq), DNA-protein interactions (ChIP-sequencing), and/or epigenome characterization. In some embodiments, resequencing of a patient's genome may be utilized, for example to detect genomic variations.

In some embodiments, detection involves using a technique such as ELISA, Western Tranfer, immunoassay, mass spectrometry, microarray analysis, etc.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described herein.

Methods of Treatment

In some embodiments, the invention provides methods for identifying cancer patients that are likely to respond favorably to treatment with an immune checkpoint modulator. In some embodiments, the invention provides methods for identifying a cancer patient that is likely to respond favorably to treatment with an immune checkpoint modulator and treating the patient with an immune checkpoint modulator. In some embodiments, the invention provides methods of treating a cancer patient with an immune checkpoint modulator who has previously been identified as likely to respond favorably to treatment with an immune checkpoint modulator. In some embodiments, the invention provides methods for identifying a cancer patient that is not likely to respond favorably to treatment with an immune checkpoint modulator and not treating the patient with an immune checkpoint modulator. In some embodiments, the invention provides methods for identifying a cancer patient who is likely to suffer one or more autoimmune complications if administered an immune checkpoint modulator. In some embodiments, the invention provides methods for treating a cancer patient with an immunosuppressant who has previously identified as likely to suffer one or more autoimmune complications if treated with an immune checkpoint modulator. In some embodiments, the immunosuppressant is administered to the patient prior to or concomitantly with an immune checkpoint modulator.

Administration of Immune Checkpoint Modulators

In accordance with certain methods of the invention, an immune checkpoint modulator is or has been administered to an individual. In some embodiments, treatment with an immune checkpoint modulator is utilized as a sole therapy. In some embodiments, treatement with an immune checkpoint modulator is used in combination with one or more other therapies.

Those of ordinary skill in the art will appreciate that appropriate formulations, indications, and dosing regimens are typically analyzed and approved by government regulatory authorities such as the Food and Drug Administration in the United States. For example, Example 5 presents certain approved dosing information for ipilumimab, an anti-CTL-4 antibody. In many embodiments, an immune checkpoint modulator is administered in accordance with the present invention according to such an approved protocol. However, the present disclosure provides certain technologies for identifying, characterizing, and/or selecting particular patients to whom immune checkpoint modulators may desirably be administered. In some embodiments, insights provided by the present disclosure permit dosing of a given immune checkpoint modulator with greater frequency and/or greater individual doses (e.g., due to reduced susceptibiloity to and/or incidence or intensity of undesirable effects) relative to that recommended or approved based on population studies that include both individuals identified as described herein (e.g., expressing neoepitopes) and other individuals. In some embodiments, insights provided by the present disclosure permit dosing of a given immune checkpoint modulator with reduced frequency and/or reduced individual doses (e.g., due to increased responsiveness) relative to that recommended or approved based on population studies that include both individuals identified as described herein (e.g., expressing neoepitopes) and other individuals.

In some embodiments, an immune system modulator is administered in a pharmaceutical composition that also comprises a physiologically acceptable carrier or excipient. In some embodiments, a pharmaceutical composition is sterile. In many embodiments, a pharmaceutical composition is formulated for a particular mode of administration.

Suitable pharmaceutically acceptable carriers include but are not limited to water, salt solutions (e.g., NaCl), saline, buffered saline, alcohols, glycerol, ethanol, gum arabic, vegetable oils, benzyl alcohols, polyethylene glycols, gelatin, carbohydrates such as lactose, amylose or starch, sugars such as mannitol, sucrose, or others, dextrose, magnesium stearate, talc, silicic acid, viscous paraffin, perfume oil, fatty acid esters, hydroxymethylcellulose, polyvinyl pyrrolidone, etc., as well as combinations thereof. A pharmaceutical preparation can, if desired, comprise one or more auxiliary agents (e.g., lubricants, preservatives, stabilizers, wetting agents, emulsifiers, salts for influencing osmotic pressure, buffers, coloring, flavoring and/or aromatic substances and the like) which do not deleteriously react with the active compounds or interference with their activity. In some embodiments, a water-soluble carrier suitable for intravenous administration is used.

In some embodiments, a pharmaceutical composition or medicament, if desired, can contain an amount (typically a minor amount) of wetting or emulsifying agents, and/or of pH buffering agents. In some embodiments, a pharmaceutical composition can be a liquid solution, suspension, emulsion, tablet, pill, capsule, sustained release formulation, or powder. In some embodiments, a pharmaceutical composition canbe formulated as a suppository, with traditional binders and carriers such as triglycerides. Oral formulation can include standard carriers such as pharmaceutical grades of mannitol, lactose, starch, magnesium stearate, polyvinyl pyrrolidone, sodium saccharine, cellulose, magnesium carbonate, etc.

In some embodiments, a pharmaceutical composition can be formulated in accordance with the routine procedures as a pharmaceutical composition adapted for administration to human beings. For example, in some embodiments, a composition for intravenous administration typically is a solution in sterile isotonic aqueous buffer. Where necessary, acomposition may also include a solubilizing agent and a local anesthetic to ease pain at the site of the injection. Generally, ingredients are supplied either separately or mixed together in unit dosage form, for example, as a dry lyophilized powder or water free concentrate in a hermetically sealed container such as an ampule or sachet indicating the quantity of active agent. Where a composition is to be administered by infusion, it can be dispensed with an infusion bottle containing sterile pharmaceutical grade water, saline or dextrose/water. Where a composition is administered by injection, an ampule of sterile water for injection or saline can be provided so that the ingredients may be mixed prior to administration.

In some embodiments, an immune checkpoint modulator can be formulated in a neutral form; in some embodiments it may be formulated in a salt form. Pharmaceutically acceptable salts include those formed with free amino groups such as those derived from hydrochloric, phosphoric, acetic, oxalic, tartaric acids, etc., and those formed with free carboxyl groups such as those derived from sodium, potassium, ammonium, calcium, ferric hydroxides, isopropylamine, triethylamine, 2-ethylamino ethanol, histidine, procaine, etc.

Pharmaceutical compositions for use in accordance with the present invention may be administered by any appropriate route. In some embodiments, a pharmaceutical composition is administered intravenously. In some embodiments, a pharmaceutical composition is administered subcutaneously. In some embodiments, a pharmaceutical composition is administered by direct administration to a target tissue, such as heart or muscle (e.g., intramuscular), or nervous system (e.g., direct injection into the brain; intraventricularly; intrathecally). Alternatively or additionally, in some embodiments, a pharmaceutical composition is administered parenterally, transdermally, or transmucosally (e.g., orally or nasally). More than one route can be used concurrently, if desired.

Immune checkpoint modulators (or a composition or medicament containing an immune checkpoint modulator, can be administered alone, or in conjunction with other immune checkpoint modulators. The term, "in conjunction with," indicates that a first immune checkpoint modulator is administered prior to, at about the same time as, or following another immune checkpoint modulator. For example, a first immune checkpoint modulator can be mixed into a composition containing one or more different immune checkpoint modulators, and thereby administered contemporaneously; alternatively, the agent can be administered contemporaneously, without mixing (e.g., by "piggybacking" delivery of the agent on the intravenous line by which the immune checkpoint modulator is also administered, or vice versa). In another example, the immune checkpoint modulator can be administered separately (e.g., not admixed), but within a short time frame (e.g., within 24 hours) of administration of the immune checkpoint modulator.

In some embodiments, subjects treated with immune checkpoint modulators are administered one or more immunosuppressants. In some embodiments, one or more immunosuppressants are administered to decrease, inhibit, or prevent an undesired autoimmune response (e.g., enterocolitis, hepatitis, dermatitis (including toxic epidermal necrolysis), neuropathy, and/or endocrinopathy), for example, hypothyroidism. Exemplary immunosuppressants include steroids, antibodies, immunoglobulin fusion proteins, and the like. In some embodiments, an immunosuppressant inhibits B cell activity (e.g. rituximab). In some embodiments, an immunosuppressant is a decoy polypeptide antigen.

In some embodiments, immune checkpoint modulators (or a composition or medicament containing immune checkpoint modulators) are administered in a therapeutically effective amount (e.g., a dosage amount and/or according to a dosage regimen that has been shown, when administered to a relevant population, to be sufficient to treat cancer, such as by ameliorating symptoms associated with the cancer, preventing or delaying the onset of the cancer, and/or also lessening the severity or frequency of symptoms of cancer). In some embodiments, long term clinical benefit is observed after treatment with immune checkpoint modulators, including, for example, PD-1 blockers such as pembrolizumab, and/or other agents. Those of ordinary skill in the art will appreciate that a dose which will be therapeutically effective for the treatment of cancer in a given patient may depend, at least to some extent, on the nature and extent of cancer, and can be determined by standard clinical techniques. In some embodiments, one or more in vitro or in vivo assays may optionally be employed to help identify optimal dosage ranges. In some embodiments, a particular dose to be employed in the treatment of a given individual may depend on the route of administration, the extent of cancer, and/or one or more other factors deemed relevant in the judgment of a practitioner in light of patient's circumstances. In some embodiments, effective doses may be extrapolated from dose-response curves derived from in vitro or animal model test systems (e.g., as described by the U.S. Department of Health and Human Services, Food and Drug Administration, and Center for Drug Evaluation and Research in "Guidance for Industry: Estimating Maximum Safe Starting Dose in Initial Clinical Trials for Therapeutics in Adult Healthy Volunteers", Pharmacology and Toxicology, July 2005.

In some embodiments, a therapeutically effective amount of an immune check point modulator can be, for example, more than about 0.01 mg/kg, more than about 0.05 mg/kg, more than about 0.1 mg/kg, more than about 0.5 mg/kg, more than about 1.0 mg/kg, more than about 1.5 mg/kg, more than about 2.0 mg/kg, more than about 2.5 mg/kg, more than about 5.0 mg/kg, more than about 7.5 mg/kg, more than about 10 mg/kg, more than about 12.5 mg/kg, more than about 15 mg/kg, more than about 17.5 mg/kg, more than about 20 mg/kg, more than about 22.5 mg/kg, or more than about 25 mg/kg body weight. In some embodiments, a therapeutically effective amount can be about 0.01-25 mg/kg, about 0.01-20 mg/kg, about 0.01-15 mg/kg, about 0.01-10 mg/kg, about 0.01-7.5 mg/kg, about 0.01-5 mg/kg, about 0.01-4 mg/kg, about 0.01-3 mg/kg, about 0.01-2 mg/kg, about 0.01-1.5 mg/kg, about 0.01-1.0 mg/kg, about 0.01-0.5 mg/kg, about 0.01-0.1 mg/kg, about 1-20 mg/kg, about 4-20 mg/kg, about 5-15 mg/kg, about 5-10 mg/kg body weight. In some embodiments, a therapeutically effective amount is about 0.01 mg/kg, about 0.05 mg/kg, about 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, about 0.9 mg/kg, about 1.0 mg/kg, about 1.1 mg/kg, about 1.2 mg/kg, about 1.3 mg/kg about 1.4 mg/kg, about 1.5 mg/kg, about 1.6 mg/kg, about 1.7 mg/kg, about 1.8 mg/kg, about 1.9 mg/kg, about 2.0 mg/kg, about 2.5 mg/kg, about 3.0 mg/kg, about 4.0 mg/kg, about 5.0 mg/kg, about 6.0 mg/kg, about 7.0 mg/kg, about 8.0 mg/kg, about 9.0 mg/kg, about 10.0 mg/kg, about 11.0 mg/kg, about 12.0 mg/kg, about 13.0 mg/kg, about 14.0 mg/kg, about 15.0 mg/kg, about 16.0 mg/kg, about 17.0 mg/kg, about 18.0 mg/kg, about 19.0 mg/kg, about 20.0 mg/kg, body weight, or more. In some embodiments, the therapeutically effective amount is no greater than about 30 mg/kg, no greater than about 20 mg/kg, no greater than about 15 mg/kg, no greater than about 10 mg/kg, no greater than about 7.5 mg/kg, no greater than about 5 mg/kg, no greater than about 4 mg/kg, no greater than about 3 mg/kg, no greater than about 2 mg/kg, or no greater than about 1 mg/kg body weight or less.

In some embodiments, the administered dose for a particular individual is varied (e.g., increased or decreased) over time, depending on the needs of the individual.

In yet another example, a loading dose (e.g., an initial higher dose) of a therapeutic composition may be given at the beginning of a course of treatment, followed by administration of a decreased maintenance dose (e.g., a subsequent lower dose) of the therapeutic composition.

Without wishing to be bound by any theories, it is contemplated that a loading dose may clear out an initial and, in some cases massive, accumulation of undesirable materials (e.g., fatty materials and/or tumor cells, etc) in tissues (e.g., in the liver), and maintenance dosing may delay, reduce, or prevent buildup of fatty materials after initial clearance.

It will be appreciated that a loading dose and maintenance dose amounts, intervals, and duration of treatment may be determined by any available method, such as those exemplified herein and those known in the art. In some embodiments, a loading dose amount is about 0.01-1 mg/kg, about 0.01-5 mg/kg, about 0.01-10 mg/kg, about 0.1-10 mg/kg, about 0.1-20 mg/kg, about 0.1-25 mg/kg, about 0.1-30 mg/kg, about 0.1-5 mg/kg, about 0.1-2 mg/kg, about 0.1-1 mg/kg, or about 0.1-0.5 mg/kg body weight. In some embodiments, a maintenance dose amount is about 0-10 mg/kg, about 0-5 mg/kg, about 0-2 mg/kg, about 0-1 mg/kg, about 0-0.5 mg/kg, about 0-0.4 mg/kg, about 0-0.3 mg/kg, about 0-0.2 mg/kg, about 0-0.1 mg/kg body weight. In some embodiments, a loading dose is administered to an individual at regular intervals for a given period of time (e.g., 1, 2, 3, 4, 5, 6, 7, 8, 9, 10, 11, 12 or more months) and/or a given number of doses (e.g., 1, 2, 3, 4, 5, 6, 7, 8, 9, 10, 15, 20, 25, 30 or more doses), followed by maintenance dosing. In some embodiments, a maintenance dose ranges from 0-2 mg/kg, about 0-1.5 mg/kg, about 0-1.0 mg/kg, about 0-0.75 mg/kg, about 0-0.5 mg/kg, about 0-0.4 mg/kg, about 0-0.3 mg/kg, about 0-0.2 mg/kg, or about 0-0.1 mg/kg body weight. In some embodiments, a maintenance dose is about 0.01, 0.02, 0.04, 0.06, 0.08, 0.1, 0.2, 0.3, 0.4, 0.5, 0.6, 0.7, 0.8, 0.9, 1.0, 1.2, 1.4, 1.6, 1.8, or 2.0 mg/kg body weight. In some embodiments, maintenance dosing is administered for 1, 2, 3, 4, 5, 6, 7, 8, 9, 10, 11, 12 or more months. In some embodiments, maintenance dosing is administered for 1, 2, 3, 4, 5, 6, 7, 8, 9, 10 or more years. In some embodiments, maintenance dosing is administered indefinitely (e.g., for life time).

A therapeutically effective amount of an immune checkpoint modulator may be administered as a one-time dose or administered at intervals, depending on the nature and extent of the cancer, and on an ongoing basis. Administration at an "interval," as used herein indicates that the therapeutically effective amount is administered periodically (as distinguished from a one-time dose). The interval can be determined by standard clinical techniques. In some embodiments, an immune checkpoint modulator is administered bimonthly, monthly, twice monthly, triweekly, biweekly, weekly, twice weekly, thrice weekly, or daily. The administration interval for a single individual need not be a fixed interval, but can be varied over time, depending on the needs and rate of recovery of the individual.

As used herein, the term "bimonthly" means administration once per two months (i.e., once every two months); the term "monthly" means administration once per month; the term "triweekly" means administration once per three weeks (i.e., once every three weeks); the term "biweekly" means administration once per two weeks (i.e., once every two weeks); the term "weekly" means administration once per week; and the term "daily" means administration once per day.

The invention additionally pertains to a pharmaceutical composition comprising an immune checkpoint modulator, as described herein, in a container (e.g., a vial, bottle, bag for intravenous administration, syringe, etc.) with a label containing instructions for administration of the composition for treatment of cancer.

EXAMPLES

The following examples are provided so as to describe to those of ordinary skill in the art how to make and use methods and compositions of the invention, and are not intended to limit the scope of what the inventors regard as their invention.

Overview

Today, more than a century since the initial observation that the immune system can reject human cancers (1), immune checkpoint inhibitors are demonstrating that adaptive immunity can be harnessed for the treatment of cancer (2-5, 60, 61). In advanced non-small cell lung cancer (NSCLC), anti-PD-1 therapies have demonstrated response rates of 17-21%, with some responses being remarkably durable (3, 6).

Understanding the molecular determinants of response to immunotherapies such as anti-PD-1 therapy is one of the critical challenges in oncology. Among the best responses to date have been seen in both melanomas and NSCLC, cancers largely caused by chronic exposure to mutagens (ultraviolet light (7) and carcinogens in cigarette smoke in lung cancers (8), respectively). However, within tumor types, there is a large variability in mutation burden, ranging from 10s-1000s (9-11). This range is particularly broad in patients with NSCLCs as tumors in never-smokers generally have few somatic mutations compared to tumors in smokers (12). We hypothesized that the mutational landscape of NSCLCs may influence how patients respond to anti-PD-1 therapy. To determine how the genomic features of NSCLCs may impact benefit from anti-PD-1 therapy, we sequenced the exomes of NSCLCs from two independent cohorts of patients treated with pembrolizumab, a humanized IgG4-kappa isotype anti-PD-1 antibody (n=16 and n=18, respectively; total n=34) and their matched normal DNA (FIG. 15).

Those skilled in the art, reading the present disclosure will appreciate that particular examples included herein are representative and not limiting. For example, those skilled in the art, reviewing the data for ipilimumab response in melanoma, as provided in detail below, represent proof of concept and establish that neoepitope mutation signatures can be predictive of response to immune checkpoint modulators. Those of ordinary skill in the art, reading the present disclosure, will appreciate and understand that the approach is broadly applicable across cancers and immune checkpoint modulator therapies.

Example 1

Mutational Landscape of Tumors from Patients with Diverse Clinical Outcomes to Pembrolizumab This example illustrates analysis of the mutational landscape of cancer, and demonstrates its effectiveness in defining useful hallmarks of patients that respond favorably or poorly to an immune checkpoint modulator. The example particularly exemplifies analysis of lung cancer patients treated with PD-1 blockade (e.g. pembrolizumab), and defines exemplary mutational characteristics in such patients.

Overall, tumor DNA sequencing generated mean target coverage of 164× and a mean of 94.5% of the target sequence was covered to a depth of at least 10×; coverage and depth were similar between both cohorts as well as between those with or without durable clinical benefit (FIG. 5). We identified a median of 200 (range 11-1192) nonsynonymous mutations per sample (FIG. 6). The median number of total exonic mutations per sample was 327 (range 45-1732). The overall quantity and range of nonsynonymous and exonic mutation burden were similar to published series of NSCLCs (13, 14) (FIGS. 7A & 7B). The transition/transversion ratio (Ti/Tv) was 0.74 (FIG. 8), also similar to previously described NSCLCs (13-15). To ensure accuracy of our sequencing data, targeted resequencing with an orthogonal method (Ampliseq) was performed using 376 randomly selected variants and mutations were confirmed in 357 (95%).

Figure 1A:
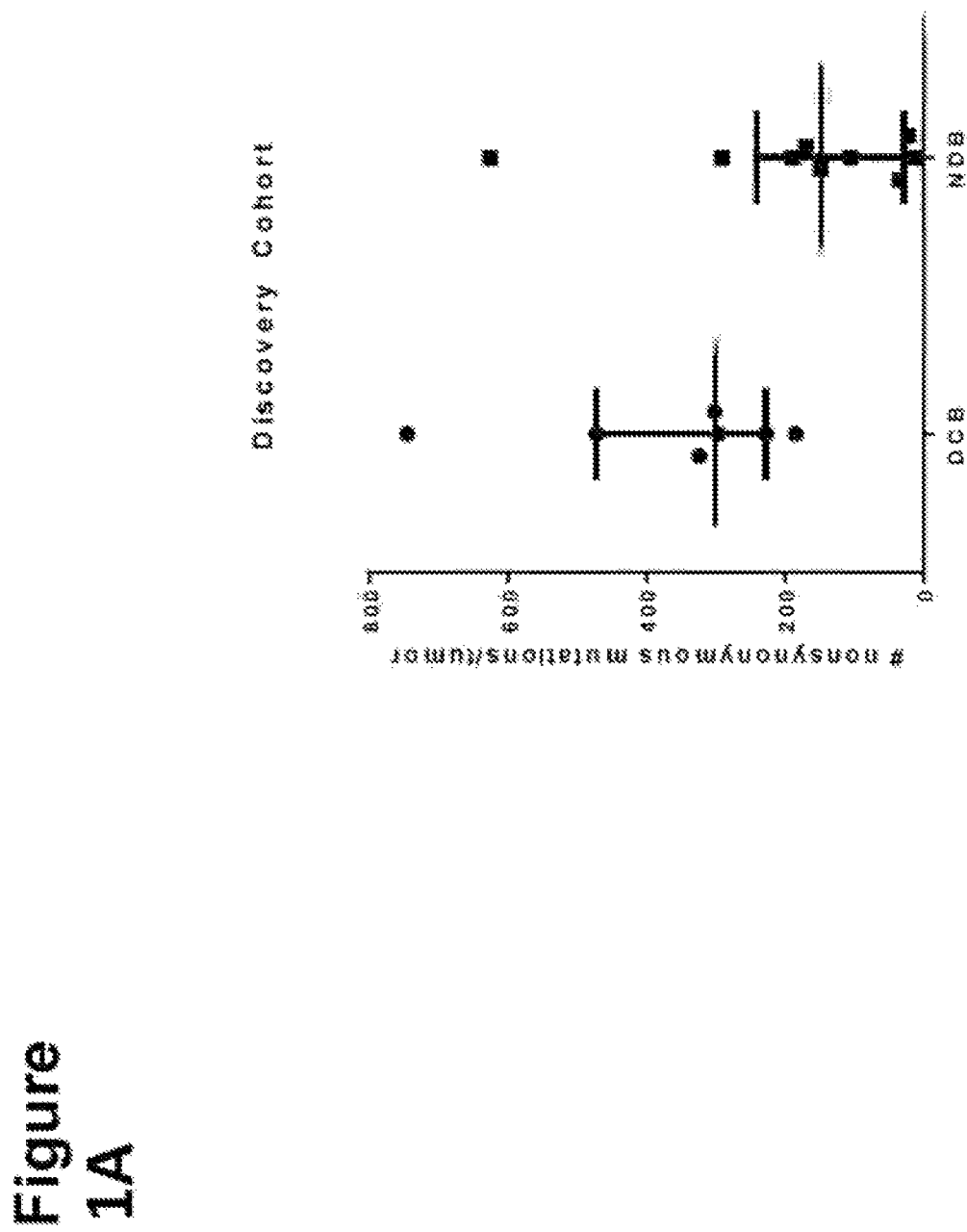
FIGS. 1A-1G shows Nonsynonymous mutation burden predicts clinical benefit with anti-PD-1 therapy. According to FIG. 1A, in the discovery cohort, nonsynonymous mutation burden is greater in tumors with DCB (n=7) compared to those with NDB (n=9) (median 302 vs 148, p=0.02).
Figure 1B:
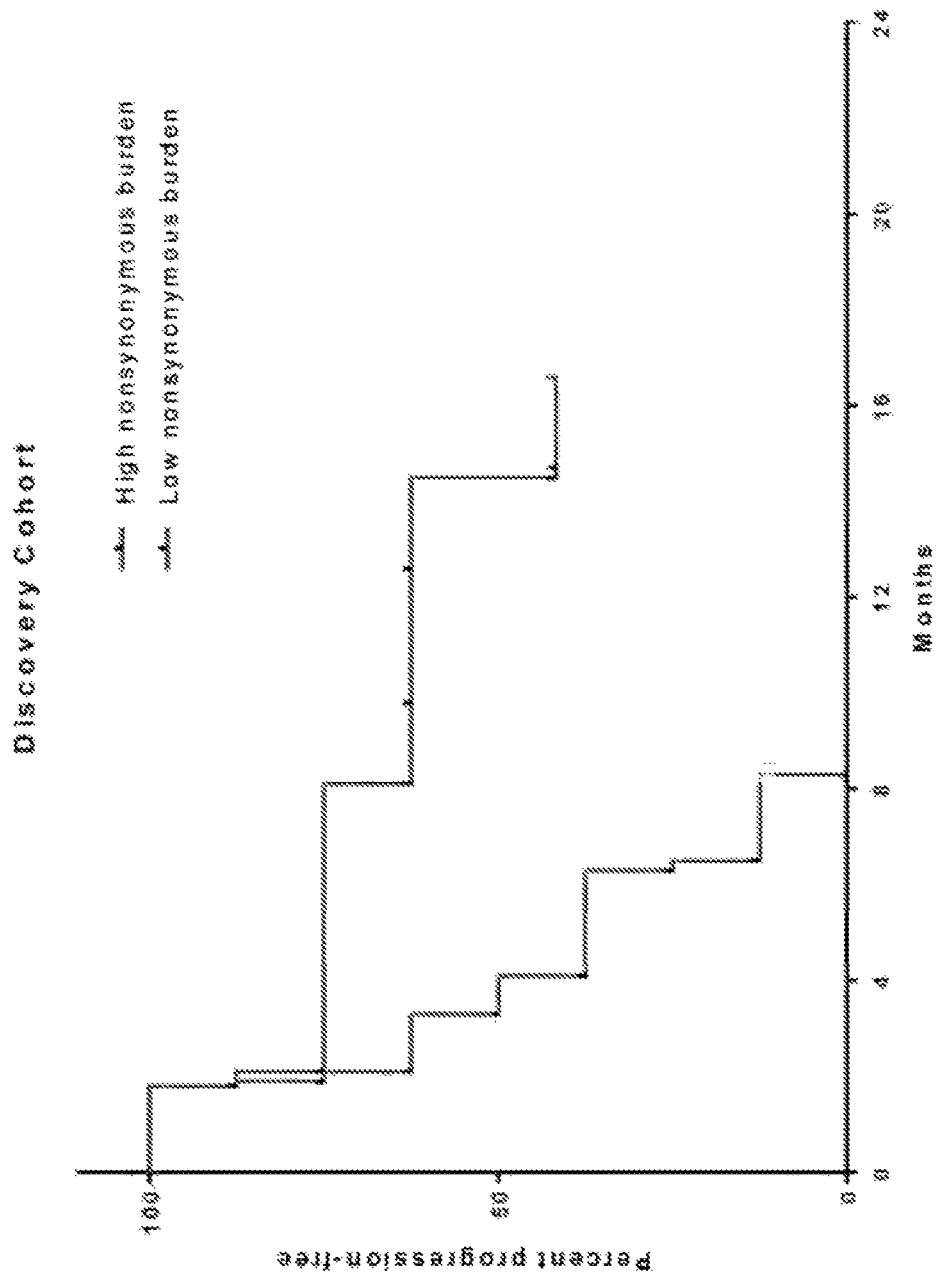

We observed that higher somatic nonsynonymous mutation burden predicted clinical efficacy of anti-PD1 therapy. In the discovery cohort (n=16), the median number of nonsynonymous mutations was 302 in patients with durable clinical benefit (DCB: partial or stable response lasting >6 months) versus 148 with no durable benefit (NDB) (p=0.02) (FIG. 1A). Seventy-three percent of patients with high nonsynonymous burden (defined as above the median burden of the cohort) experienced DCB compared to 13% of those with low mutation burden (p=0.04). Both confirmed objective response rate (ORR) and progression-free survival (PFS) were higher in patients with high nonsynonymous burden (ORR 63% vs. 0%, p=0.03; median PFS 14.5 vs. 3.7 months, p=0.02; HR 0.19, 95% CI 0.05-0.70) (FIG. 1B; FIG. 16).

Figure 1C:
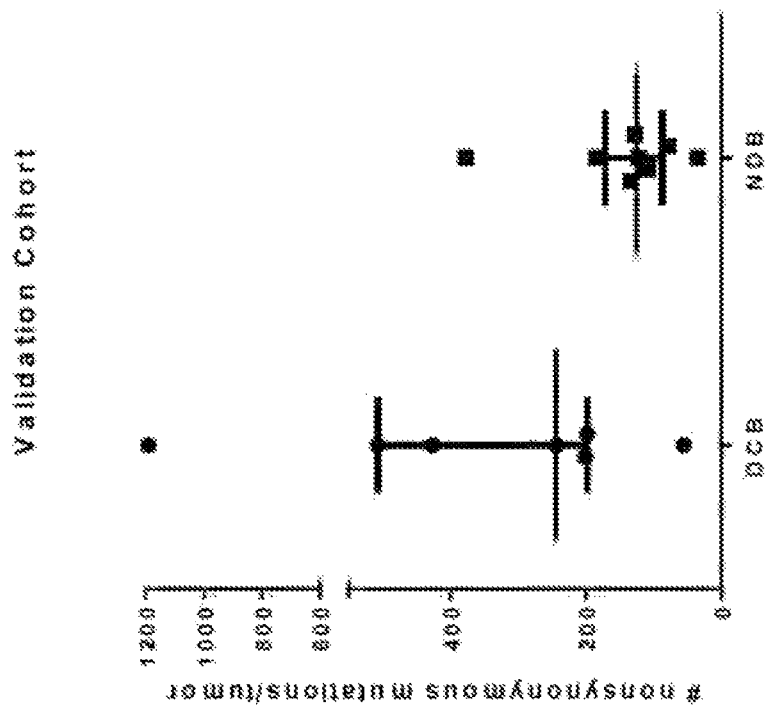
Figure 1D:
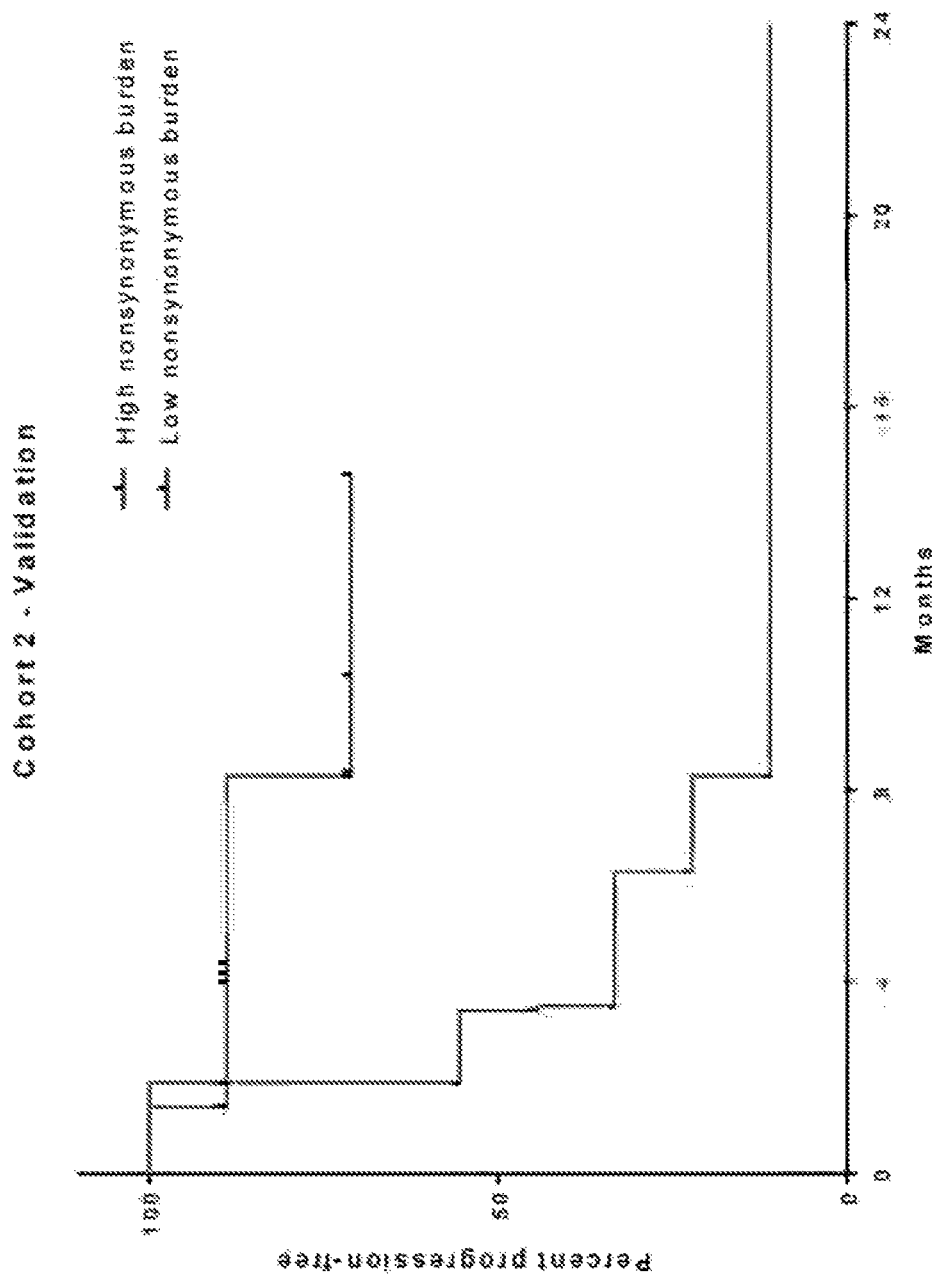

The validation cohort included an independent set of 18 NSCLC samples from patients treated with pembrolizumab; three patients currently on therapy have not yet reached six months of follow up and are therefore not included in calculations of DCB. The clinical characteristics of the validation cohort were similar to the discovery cohort, although there were more never-smokers in the validation cohort (5/18 vs 1/16). The median nonsynonymous mutation burden was 244 in tumors from patients with DCB compared 125 in the NDB group (p=0.04) (FIG. 1C). The rate of DCB and PFS were again both significantly greater in tumors with a nonsynonymous mutation burden above the median (DCB 83% vs 22%, p=0.04; median PFS not reached vs. 3.4 months, log rank p=0.006; HR 0.15, 95% CI 0.04-0.59) (FIG. 1D; FIG. 16).

Figure 1E:
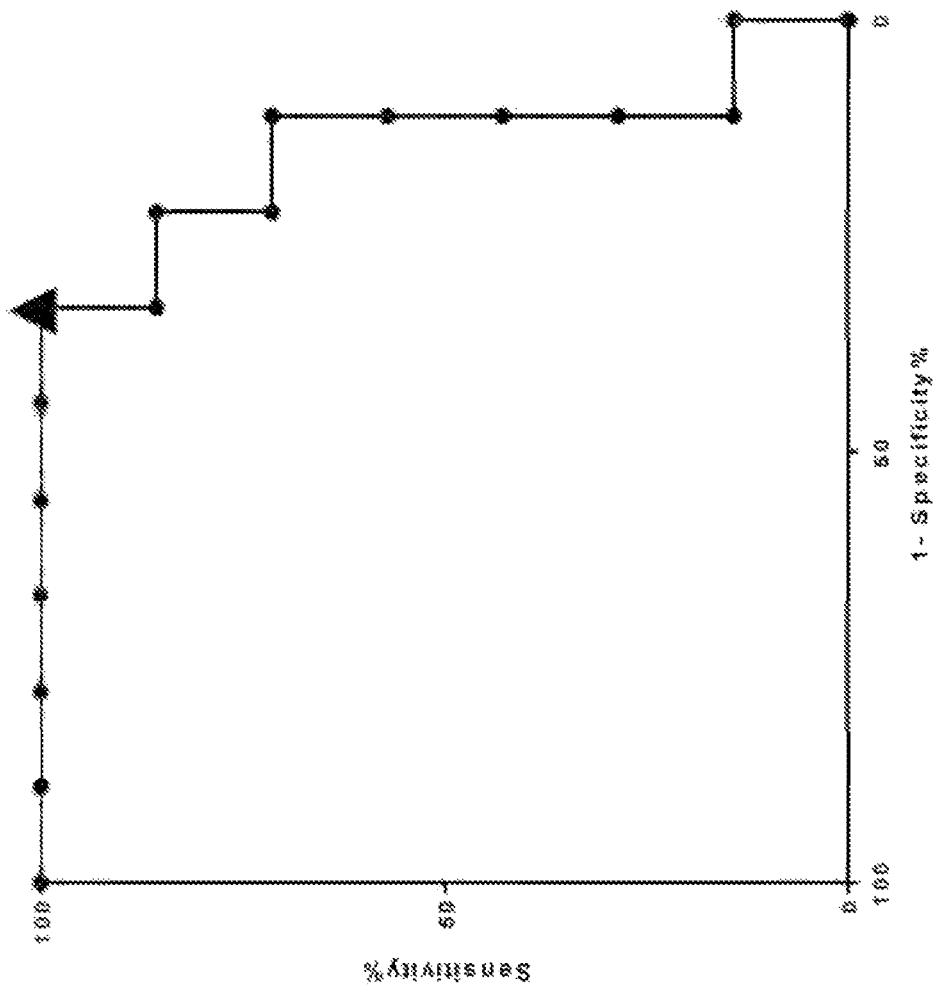

In the discovery cohort, there was high concordance between nonsynonymous mutation burden and DCB, with an area under the receiver operator characteristic curve (AUC) of 87% (FIG. 1E). Patients with nonsynonymous mutation burden ≥178, the cut point that combined maximal sensitivity with best specificity, had a likelihood ratio for DCB of 3.0; the sensitivity and specificity of DCB using this cut point was 100% (95% CI 59-100) and 67% (29-93), respectively. Applying this cut point to patients within the validation cohort, the rate of durable benefit in patients with tumors harboring ≥178 mutations was 75% compared to 14% in those with <178. This corresponded to a sensitivity of 86% and specificity of 75%.

Figure 1F:
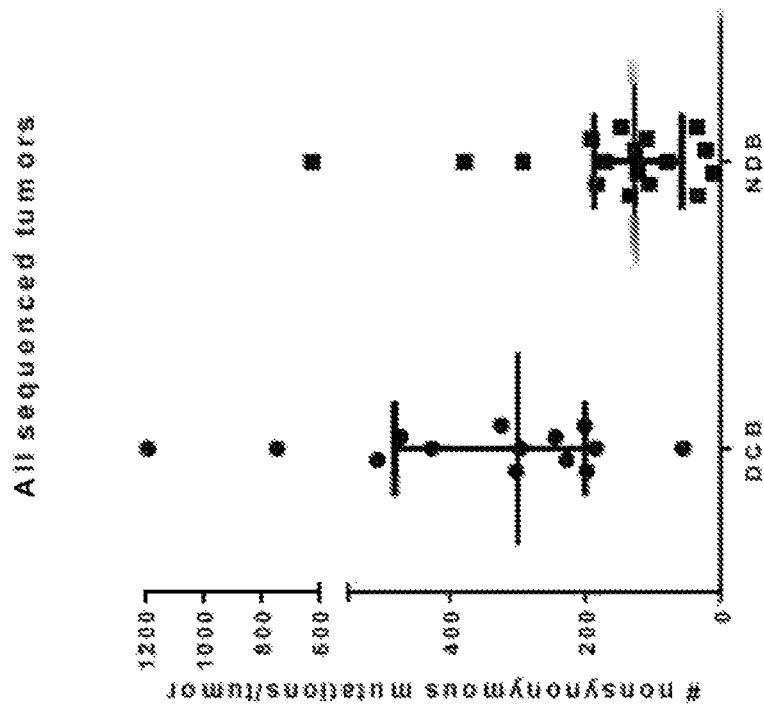
Figure 1G:
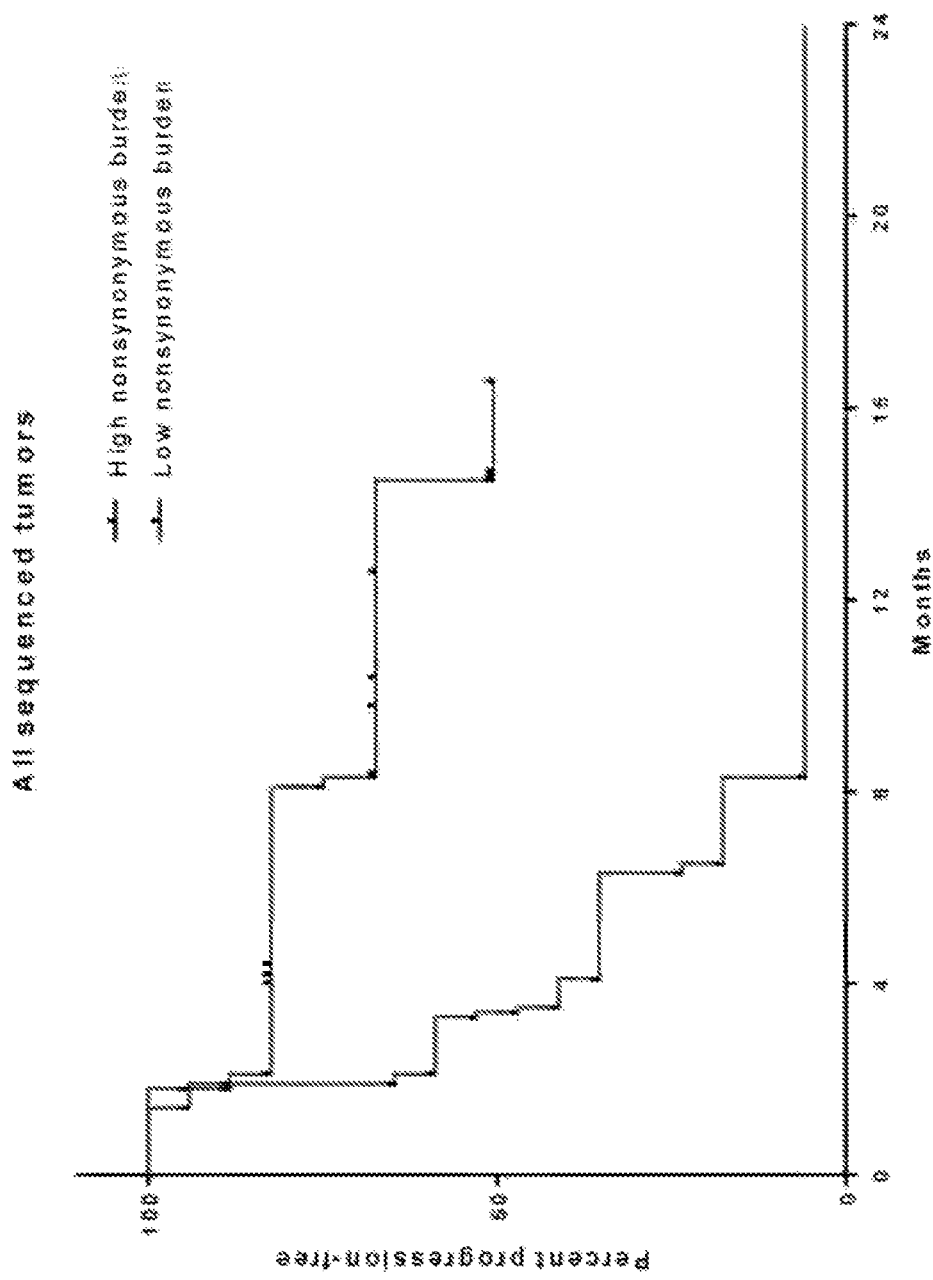

There were few but important exceptions. 5 of 18 tumors with ≥178 nonsynonymous mutations had NDB and one tumor with a very low burden (56 nonsynonymous mutations) had a partial response to pembrolizumab. However, this response was transient, lasting only 8 months. Across both cohorts, this is the only patient with a tumor mutation burden <178 with a confirmed objective response. Notably, although higher nonsynonymous mutation burden was predictive of ORR, DCB, and PFS (FIGS. 1F, 1G), this correlation was less evident when examining total exonic mutation burden (FIG. 16).

Example 2

Somatic Mutation Signatures Associated with Treatment Efficacy

This example demonstrates that certain somatic mutation signatures are associated with efficacy of treatment with an immune checkpoint modulator.

Figure 2A:
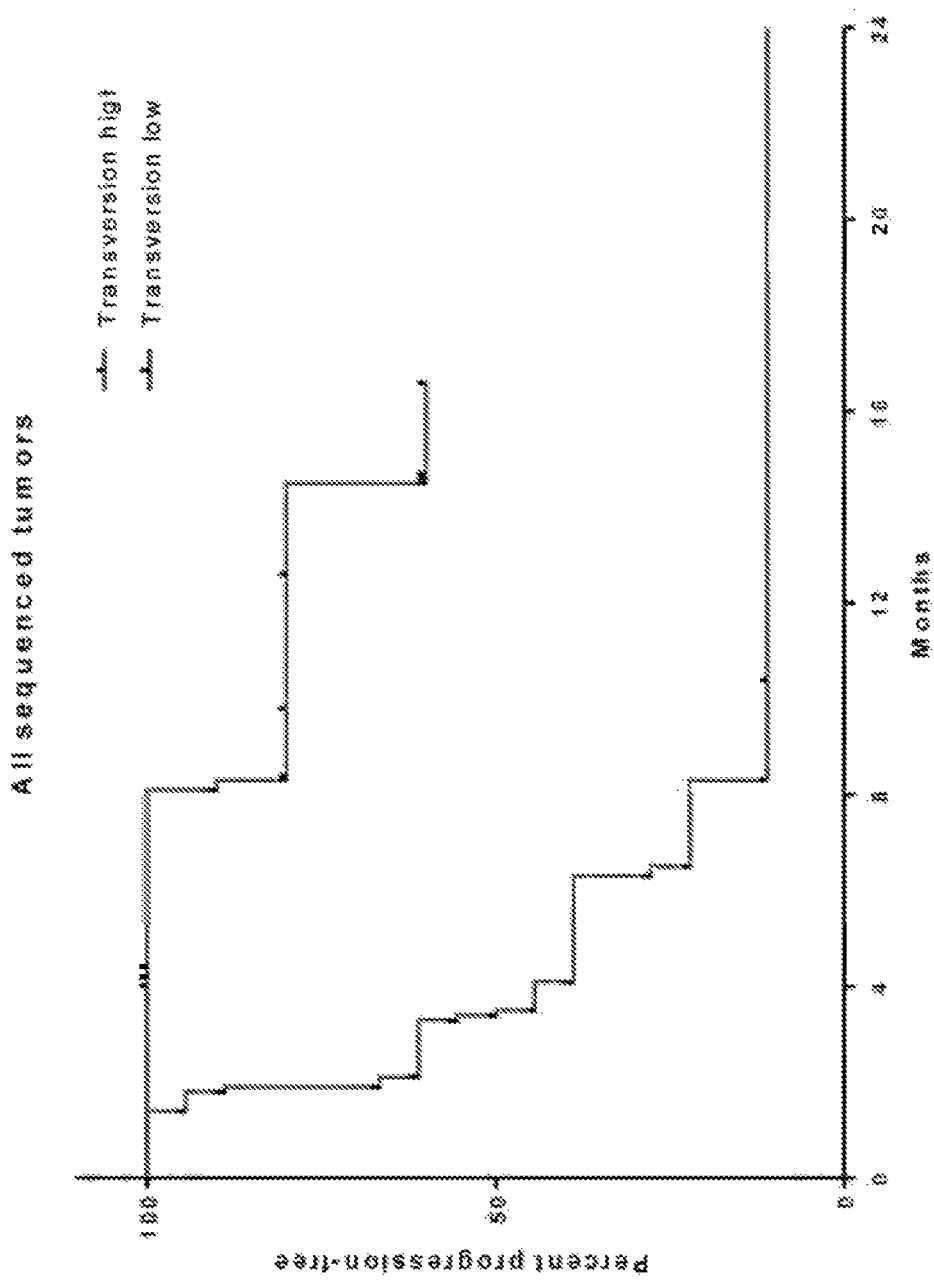
FIGS. 2A-2B show smoking and response to pembrolizumab in NSCLC.
Figure 2B:
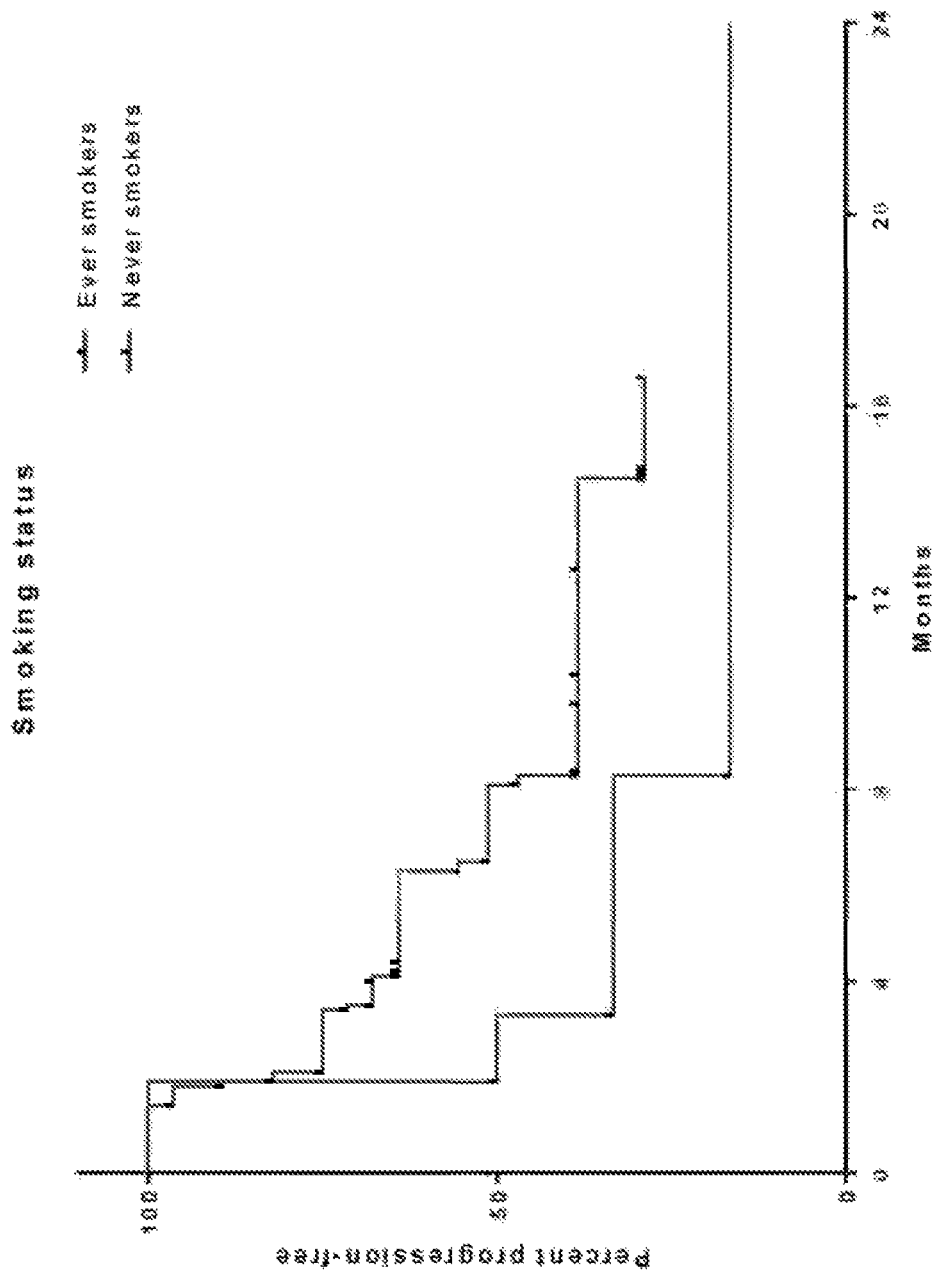

We examined all 34 exomes collectively to determine how patterns of mutational changes associated with response to pembrolizumab. C>A transversions were more frequent and C>T transitions were less frequent in patients with DCB compared to NDB (p=0.01 for both, FIG. 9). A previously validated binary classifier to identify the molecular signature of smoking (14) was applied to differentiate transversion-high (TH, smoking signature) from transversion-low (TL, never smoking signature) cases. Strikingly, patients with tumors harboring the smoking signature were more likely to respond to pembrolizumab. The ORR in TH tumors was 56% vs 17% in TL tumors, p=0.03; the rate of DCB was 77% vs 22%, p=0.004, and the PFS was also significantly longer in TH tumors (median not reached vs 3.5, p=0.0001) (FIG. 2A). Of note, self-reported smoking history did not significantly associate with DCB (never-smokers, 33%, vs. ever smokers, 48%, p=0.66) or PFS (FIG. 2B). Neither the rate of DCB nor PFS were significantly different in ever smokers versus never smokers (Fisher's exact p=0.66 and log-rank p=0.29, respectively) or heavy smokers (greater than median pack-years, 25) versus light/never smokers (≤25 pack-years) (Fisher's exact p=0.08 and log-rank p=0.15, respectively). The molecular smoking signature correlated more significantly with nonsynonymous mutation burden than smoking history (FIG. 19).

Figure 3:
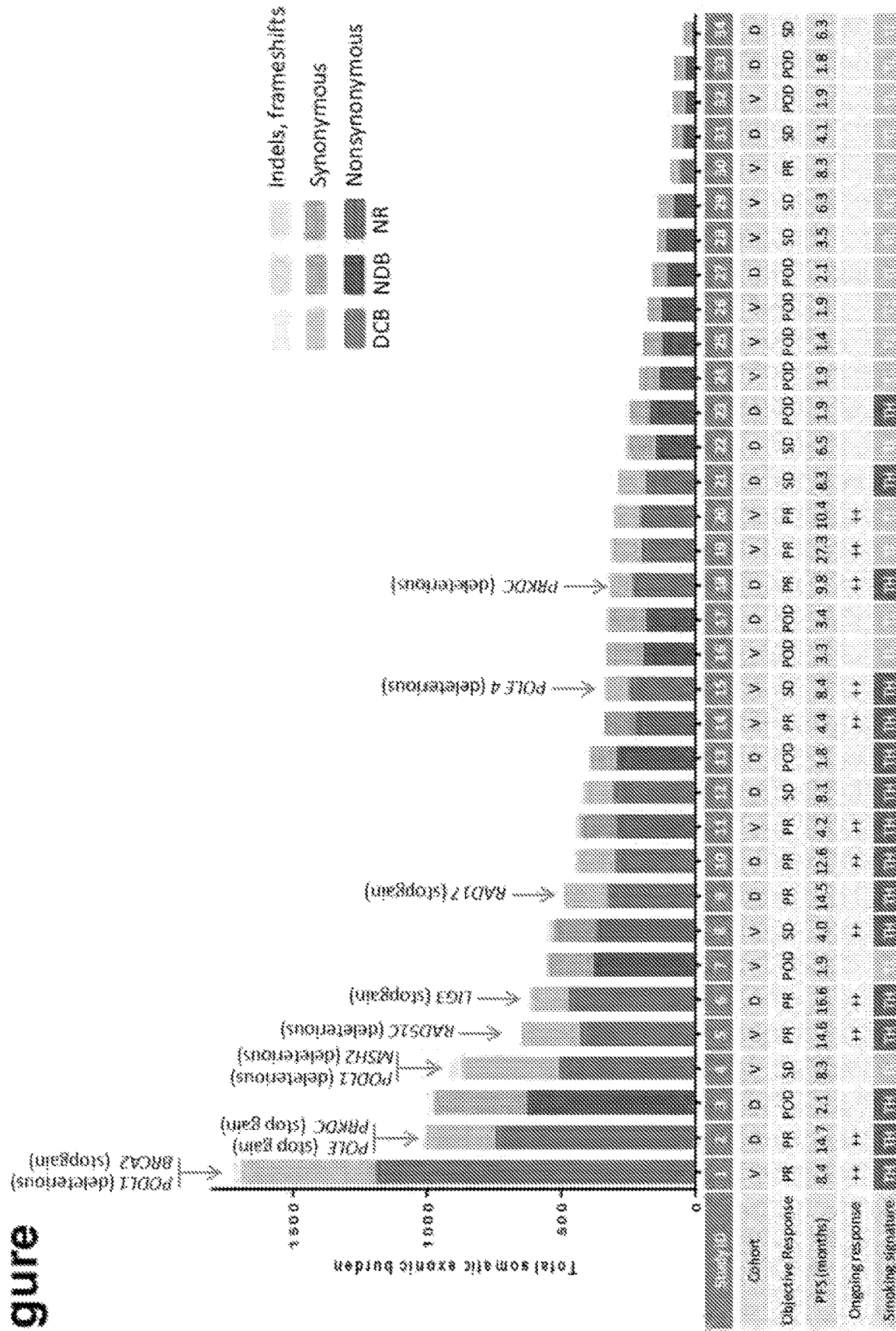
FIG. 3 shows mutation burden, clinical response, and factors contributing to mutation burden. Total exonic mutation burden for each sequenced tumor with nonsynonymous (dark shading), synonymous (medium shading), and indels/ frameshift mutations (light shading) displayed in the histogram. Columns are shaded to indicate durable response (DCB, green; NDB, red; not reached 6 months follow-up (NR), blue). The cohort identification (D, discovery; V, validation), best objective response (PR, partial response; SD, stable disease; POD, progression of disease), and progression-free survival (censored at the time of data lock) are reported in the table. Those with ongoing progression-free survival are labeled with ++. The presence of the molecular smoking signature is displayed with TH cases (purple) and TL cases (orange). The presence of deleterious mutations in specific DNA repair/replication genes is noted by the arrows.

Although the multitude of carcinogens in tobacco smoke are largely responsible for the mutagenesis in lung cancers (16), the wide range of mutation burden within both smokers and never-smokers raises the question of whether additional pathways may also contribute to accumulation of somatic mutations. Interestingly, we found deleterious mutations in a number of genes that are important in DNA repair or are predicted to cause higher mutations rates when mutated. For example, in the three responders with the highest mutation burden, we identified deleterious mutations in polymerase (DNA directed), Delta 1, Catalytic Subunit (POLD1), polymerase (DNA directed), epsilon, catalytic subunit (POLE), and MutS Homolog 2 (MSH2) (FIG. 3). Of particular interest, a POLD1 E374K mutation (SIFT 0.0, POLYPHEN deleterious) was identified in the tumor of a never-smoker with DCB and whose tumor harbored the greatest nonsynonymous mutation burden (n=507) of all never-smokers in our series. POLD1 Glu374 lies in the exonuclease proofreading domain of Pol δ (17), and mutation of this residue may contribute to low fidelity replication of the lagging DNA strand. Consistent with this hypothesis, the exome of this patient was characterized by a relatively low proportion of C>A transversions (20%) and a predominance of C>T transitions (51%), which is similar to other POLD1 mutant, hypermutated tumors (18) and distinct from smoking-related lung cancers. Another responder, with the greatest mutation burden in our series, had a C284Y mutation in POLD1, which is also located in the exonuclease proofreading domain. Similarly, we observed nonsense mutations in PRKDC, the catalytic subunit of DNA-PK, and RAD17. Both genes are well known to be required for proper DNA repair and maintenance of genomic integrity (19, 20).

In addition to specific DNA repair-associated genes, genes that harbored deleterious mutations common to four or more DCB patients and not present in NDB patients included POLR2A, KEAP1, PAPPA2, PXDNL, RYR1, SCN8A, and SLIT3. Mutations in KRAS were found in 7/14 tumors from patients with DCB compared to 1/17 in the NDB group, a finding that may be explained by the previously reported association between smoking and presence of KRAS mutations in NSCLC (21). There were no mutations or copy number alterations in antigen presentation pathway-associated genes or CD274 (encoding programmed cell death ligand-1, PD-L1) that associated with response or resistance.

How does increased mutation burden affect tumor immunogenicity? The observation that nonsynonymous mutation burden predicts clinical benefit is consistent with the hypothesis that recognition of neoantigens, formed as a consequence of somatic mutations, is important for the activity of anti-PD-1 therapy. We therefore examined the landscape of candidate neoantigens in this tumor set using our previously described computational pipeline (22) (FIG. 10). Briefly, this pipeline identifies mutant nonamers with ≤500 nM binding affinity for patient-specific class I HLA alleles (23, 24), which are considered candidate neoantigens. We identified a median of 112 neoantigens per tumor (range 8-610) and, as expected (25), the quantity of candidate neoantigens per tumor correlated with mutation burden (Spearman ρ0.91, p<0.0001), similar to the correlation recently reported across cancers (63). Tumors from patients with DCB had significantly higher neoantigen burden compared to those with NDB (median 203 vs 83, p=0.001, FIG. 4A), and high neoantigen burden was associated with improved PFS (median 14.5 vs 3.5 months, p=0.002; HR 0.23, 95% CI 0.09-0.58) (FIG. 4B). The presence of specific HLA alleles did not correlate with clinical efficacy (FIG. 11). The absolute burden of neoantigens, but not the frequency of neoantigens per nonsynonymous mutation, correlated with the degree of response to anti-PD-1 therapy (FIG. 12).

In our study, the goal was not to seek to comprehensively validate all possible candidate neoantigens. Rather, we set out to determine whether anti-PD-1 therapy can alter neoantigen specific T-cell reactivity and whether this can be used for immune monitoring following treatment with anti-PD-1 therapy. To directly test this, candidate neoantigens identified from one patient with a 95% decrease in tumor burden with pembrolizumab were examined. Identified candidate neoantigens were examined in a patient (Study ID #9 in FIG. 3 and FIG. 17) with exceptional response to pembrolizumab and available peripheral blood lymphocytes (PBLs). Predicted HLA-A restricted peptides were synthesized and used to screen for autologous T-cells using a validated high-throughput MHC multimer screening strategy (26, 27) to assess neoantigen-specific reactivity ex vivo in serially collected peripheral blood lymphocytes (PBLs) (Day 0, 21, 44, 63, 256, and 297, where Day 0 is the first date of treatment). This analysis revealed a dominant CD8+ T-cell response against a neoantigen resulting from a HERC1 P3278S mutation (ASNASSAAK (SEQ ID NO: 344)) (FIG. 4C). Notably, this T-cell response was below the level of detection at start of therapy (level of detection of 0.005%), but increased to readily detectable levels within 3 weeks post therapy initiation (0.040% of CD8+ T-cells) and was maintained at Day 44 (0.044% of Cd8+ T-cells). This rapid induction of T cell reactivity correlated with tumor regression and returned to levels just above background in the subsequent months as tumor regression plateaued (FIG. 4D). HERC1 P3278S-multimer reactive T-cells from PBLs collected on day 44 were characterized by a CD45RA-CCR7-HLA-DR+LAG-3-phenotype, consistent with an activated effector population (FIG. 20). These data reveal autologous T-cell responses against cancer neoantigens in the context of a clinical response to anti-PD-1 therapy. To our knowledge, this is first use of cancer exome data to uncover autologous T-cell responses against cancer neoantigens in the context of a clinical response to anti-PD-1 therapy.

Example 3

In Vitro Analyses of Immunogenic Peptides

This example demonstrates the in vitro validation of immunogenic peptides.

To validate the specificity of the neoantigen reactive T-cells, PBLs from day 63 and 297 were expanded in vitro in the presence of the mutant peptide and subsequently re-stimulated with either mutant or wild-type peptide (ASNASSAAK (SEQ ID NO: 344) vs ASNAPSAAK (SEQ ID NO: 5925)), and analyzed by intracellular cytokine staining. At both time points, a substantial population of polyfunctional CD8+ T-cells (characterized by IFNγ, CD107a, MIP1β (the chemokine CCL4), and TNFα production) was detected in response to mutant but not wild-type peptide (FIGS. 4E, 13A-D).

The success of T-cell checkpoint therapies in a number of cancers (2-5) has confirmed the ability to re-establish a tumor-directed effector T-cell response. However, only a subset of patients benefit from these therapies and the determinants and mediators of response are unknown. In the current study, it is shown that in NSCLCs treated with pembrolizumab, elevated nonsynonymous mutation burden is strongly predictive of clinical efficacy and can be used to identify patients with high likelihood of benefit. In addition, clinical efficacy correlates with a molecular signature characteristic of tobacco carcinogen-related mutagenesis, certain DNA repair mutations, and with the burden of neoantigens. Furthermore, we describe an example of using cancer exome data from a lung cancer patient to identify an autologous neoantigen-specific peripheral blood T-cell response that correlated temporally with a rapid and durable response to pembrolizumab.

As expected, mutation burden, smoking signature, and neoantigen burden were closely associated, which limits the capacity for multivariate analysis to distinguish the independent influence of each factor on response to pembrolizumab. Nevertheless, it should be noted that the molecular smoking signature correlated with efficacy while self-reported smoking status did not, highlighting the power of the classifier to identify molecularly-related tumors within a heterogeneous group. Moreover, the correlation between the molecular signature of smoking in the exomes examined and clinical efficacy has important potential implications. As molecular evidence of smoking can be identified by limited genomic assessment (8), it would be interesting to examine whether the molecular smoking signature alone can be used to predict response to anti-PD-1 therapy without the need to sequence the entire exome.

Nearly all tumors in this study (91%) were positive for PD-L1 expression (≥1% membranous staining; clone 22C3, Merck & Co., Inc. (6)). This marker appears to enrich for response (3, 6, 28), but many tumors deemed PD-L1 positive do not respond to anti-PD-1 therapies and responses are also seen in patients with PD-L1 negative tumors (6, 28). Previous studies have reported that pre-treatment PD-L1 expression enriches for response to anti-PD-1 therapies (3, 6, 28), but many tumors deemed PD-L1 positive do not respond and some responses occur in PD-L1 negative tumors (6, 28). Semi-quantitative PD-L1 staining results were available for 30 of 34 patients, where strong staining represented ≥50% PD-L1 expression, weak represented 1-49%, and negative represented <1% (clone 22C3, Merck (6)). As this trial largely enrolled patients with PD-L1 tumor expression, most samples had some degree of PD-L1 expression (24 of 30, 80%, FIG. 17), limiting the capacity to determine relationships between mutation burden and PD-L1 expression. Among those with high nonsynonymous mutation burden (>200, above median of overall cohort) and some degree of PD-L1 expression (weak/strong), the rate of DCB was 91% (10 of 11, 95% CI 59-99%). In contrast, in those with low mutation burden and some degree of PD-L1 expression, the rate of DCB was only 10% (1 of 10, 95% CI 0-44%). When exclusively examining patients with weak PD-L1 expression, high nonsynonymous mutation burden was associated with DCB in 75% (3 of 4, 95% CI 19-99%) while low mutation burden was associated with DCB in 11% (1 of 9, 0%-48%). Large-scale studies are needed to determine the relationship between PD-L1 intensity and mutation burden. Additionally, recent data have demonstrated that the localization of PD-L1 expression within the tumor microenvironment (on infiltrating immune cells (32), at the invasive margin, tumor core, etc. (33)) may affect the use of PD-L1 as a biomarker.

T-cell recognition of cancers relies upon presentation of tumor-specific antigens on MEW molecules by cancer cells and professional antigen presenting cells (29). A few elegant pre-clinical (30-33, 66-68) and clinical (25, 34-36, 69) reports have demonstrated that neoantigen-specific effector T-cell response can recognize and shrink established tumors (36). Our finding that nonsynonymous mutation burden was more predictive of clinical benefit with anti-PD-1 therapy compared to total exonic mutation burden suggests the importance of neoantigens in dictating response. In support of this, for the first time, the temporal association between the expansion of neoantigen-specific T-cells in peripheral blood with radiographic response to anti-PD-1 therapy is shown. The observation that anti-PD-1-induced neoantigen specific T cell reactivity can be observed within the peripheral blood compartment may open the door to the development of blood-based assays to uncover functional neoantigens and to monitor response following anti-PD-1 therapy. Certain neoantigen sequences are included herein in FIG. 21.

The recent development of T-cell checkpoint inhibitors has begun to transform the treatment landscape for patients with a number of high prevalence malignancies. These findings impact our understanding of response to anti-PD-1 therapy and on its application in the clinic. The ability to identify those patients most likely to benefit from these therapies, as demonstrated here by analysis of nonsynonymous mutation burden, will contribute to maximizing the clinical value of these novel therapies.

Example 4

Materials and Methods for Examples 1-3

The present example provides detailed Materials & Methods for the work presented herein in examples 1-3.

We obtained tumor tissue from lung cancer patients who were treated with pembrolizumab. These samples were from pembrolizumab-treated patients who experienced a long term benefit (LB), or minimal/no benefit (NB). Whole exome sequencing was performed on these tumors and matching normal blood. Somatic mutations and candidate somatic neoantigens generated from these mutations were identified and characterized.

Patients and Clinical Characteristics

All patients had stage IV non-small cell lung cancer (NSCLC) and were treated at Memorial Sloan Kettering Cancer Center (n=29) or the University of California at Los Angeles (n=5) on protocol NCT01295827 (FIG. 17). All patients initiated therapy in 2012-2013 and were treated at 10 mg/kg every 2-3 weeks, except for 5 patients treated at 2 mg/kg every 3 weeks. The overall response rate and progression-free survival are reported to be similar across dose and schedules (6). All patients had consented to Institutional Review Board-approved protocols permitting tissue collection and sequencing. PD-L1 expression was assessed prospectively by immunohistochemistry using a previously validated murine anti-human anti-PD-L1 antibody (clone 22C3, Merck & Co., Inc.). Membranous expression of PD-L1 on tumor cells and infiltrating immune cells were scored. 31 (91%) scored at least 1% positive for PD-L1 expression; 2 patients were PD-L1 negative; and 1 was unknown. Smoking status was evaluated using previously completed self-reported smoking questionnaires executed as standard of care at MSKCC or review of medical records at UCLA. Patients eligible for this analysis all received at least two doses of study therapy and were evaluable for response to pembrolizumab, and did not prematurely discontinue therapy due to toxicity or withdrawal of consent.

Tumor Samples

All tumor tissue used for sequencing was obtained prior to dosing with pembrolizumab, except for one non-responder in whom post-treatment tissue was used (study ID DM123062). Tumor samples used for whole exome sequencing were paraffin-embedded (FFPE). Peripheral blood was collected and DNA isolated from all patients (Nucleospin Blood L, Machery-Nagel). Presence of tumor tissue in the sequenced samples was confirmed by examination of a representative hematoxylin and eosin-stained slide by thoracic pathologists (N.R. or A.M). DNA extraction was performed using the DNEasy kit (Qiagen).

Clinical Efficacy Analysis

Objective response to pembrolizumab was assessed by investigator-assessed immune-related response criteria (irRC) (37) by a study radiologist. Per protocol, CT scans were performed every nine weeks. Partial and complete responses were confirmed by a repeat imaging occurring at least 4 weeks after the initial identification of response; unconfirmed responses were considered stable or progressive disease dependent on results of the second CT scan. Durable clinical benefit (DCB) was defined as stable disease or partial response lasting longer than 6 months (week 27, the time of third protocol-scheduled response assessment). No durable benefit (NDB) was defined as progression of disease ≤6 months of beginning therapy. Patients who were still ongoing study therapy at the time of the data lock (Oct. 10, 2014) but who had not yet reached 6 months of follow up were considered "Not reached" (NR). These patients were not included in the analysis of DCB/NDB, but were included in assessments of objective response and progression-free survival. For patients with ongoing response to study therapy, progression free survival was censored at the date of the most recent imaging evaluation. For alive patients, overall survival was censored at the date of last known contact.

Whole Exome Capture and Sequencing

Whole-exome capture libraries were constructed via the Agilent Sure-Select Human All Exon v2.0, 44Mb baited target with the Broad in-solution hybrid selection process. Enriched exome libraries were sequenced on the HiSeq 2000 platform (Illumina) to generate paired-end reads (2×76 bp) to a goal of 150× mean target coverage (Broad Institute, Cambridge, Mass.) (FIGS. 14A-14Q, FIG. 18).

HLA Typing

HLA typing was performed at the MSKCC HLA typing lab New York Blood Center by high resolution SeCore HLA sequence-based typing method (HLA-SBT) (Invitrogen). ATHLATES (http://www.broadinstitute.org/scientific-community/science/projects/viral-genomics/athlates) (38) was also used for HLA typing and confirmation.

Exome Analysis Pipeline

Raw sequencing data were aligned to the hg37 genome build using the Burrows-Wheeler Aligner (BWA) version 0.7.10 (39) (FIG. 6). Further indel realignment, base-quality score recalibration and duplicate-read removal were performed using the Genome Analysis Toolkit (GATK) version 3.2.2 (40). Mutations were annotated using SnpEffect version 3.5d (build 2014-03-05) (41). Somatic Sniper version 1.0.0 (42), VarScan version 2.2.3 (43), Strelka version 1.0.13 (44) and MuTect version 1.4 (45) were used to generate single nucleotide variant (SNV) calls using default parameters. VarScan and Strelka were used to generate indel calls. Baseline filters (depth of 7X coverage in tumor specimens, >97% normal allelic fraction, >10% tumor allelic fraction) were chosen. Known single nucleotide polymorphisms (SNPs) were eliminated by comparison to 1000 Genomes Project, ESP6500 (National Heart, Lung and Blood Institute [NHLBI] GO Exome Sequencing Project) and dbSNP132 (46-48). Single nucleotide polymorphisms (SNPs) that were rare in the SNP data bases and present in tumors with an allelic fraction of zero in the normal DNA were manually reviewed using Integrative Genomics Viewer (IGV) and included as somatic SNVs (49). Manual review using IGV was also conducted for all mutations in any of the following additional three categories: (i) called by one caller (ii) coverage between 7X and 35X (iii) tumor allelic frequency less than 10 percent but called by two or more callers. Called SNVs were evaluated as deleterious if denoted as such by snpEff (high), SIFT (50) (score <0.05) or PolyPhen-2 ("D" or "P") (51). SIFT and Polyphen2 prediction scores and GERP++ conservation scores were parsed from dbNSFP version 2.2 (52). Validation resequencing of detected mutations is >97% (53).

Molecular Signature Analysis

The mutation spectrum in each sample was calculated by analyzing nonsynonymous exonic single nucleotide substitutions within their trinucleotide sequence context. That is, for each sample the percentage of each of the six possible single nucleotide changes (C>A:G>T, C>G:G>C, C>T: G>A, T>A:A>T, T>C:A>G, T>G:A>C, with the pyrimidine of the Watson-Crick base pair referenced first) within each of the 16 possible combinations of flanking nucleotides was calculated to generate a 96-feature vector that is used to represent the mutation spectrum for that sample. We utilized a Support Vector Machine (R package e1071) to generate a binary classifier to distinguish transversion low (TL) and transversion high (TH) tumors. Similar to a previously published analysis (14), the classifier was trained using lifelong never smokers and patients with ≥60 pack-years of smoking history as the respective controls. The training set was derived from publicly available exome sequencing and smoking history data from TCGA and previously published results (54). This classifier was applied to all sequenced patients in order to classify all samples as belonging to either the TL or TH categories.

In Silico Neoantigen Pipeline

All nonsynonymous point mutations identified were translated into strings of 17 amino acids with the mutant amino acid situated centrally using a bioinformatic tool called NAseek (22). A sliding window method was used to identify the 9 amino acid substrings within the mutant 17mer that had MHC Class I binding affinity of ≤500 nM to one (or more) of the patient-specific HLA alleles. Binding affinity for the mutant and corresponding wild type nonamer were analyzed using NetMHCv3.4 software (23, 24, 55-57).

Combinatorial Coding and Multimer Screening

HLA-A restricted candidate neoantigens were synthesized in-house (Netherlands Cancer Institute) and HLA-multimers containing these peptides were produced by micro-scale parallel UV-induced peptide exchange reactions as previously described (26, 58). Briefly, peptide-MHC complexes loaded with UV-sensitive peptide were subjected to 366-nm UV light (CAMAG) for one hour at 4° C. in the presence of candidate neoantigen peptide in a 384-well plate. pMHC multimers were generated using a total of 11 different fluorescent streptavidin (SA) conjugates (Invitrogen). For each pMHC monomer, conjugation was performed with two of these fluorochromes. NaN3 (0.02% w/v) and an excess of D-biotin (26.4 mM, Sigma) were added to block residual binding sites. For T cell staining an combinatorial encoding strategy was employed to be able to analyze for reactivity against up to 47 different peptides in parallel (27). The PBMC samples were thawed, treated with DNAse for 1 h and stained with pMHC multimer panels for 15 min at 37 C. Subsequently, anti-CD8-AF700 (Invitrogen), anti-CD4-FITC (Invitrogen), anti-CD14-FITC (Invitrogen), anti-CD16-FITC (Invitrogen), anti-CD19-FITC (Invitrogen), and LIVE/DEAD Fixable IR Dead Cell Stain Kit (Invitrogen) were added for additional 20 min on ice. Data acquisition was performed on an LSR II flow cytometer (Becton Dickinson) with FACSDiva 6 software. Cutoff values for the definition of positive responses were ≥0.005% of total CD8+ cells and ≥10 events. For immunophenotypical analysis, day 44 PMLs were stained with HERC1 P3278S MHC multimers in two colors (qdot 625 (Invitrogen) and PerCPe-Fluor710 (ebioscience)) plus anti-CD45RA Ab (Invitrogen), anti-CCR7 Ab (BD Bioscience), anti-HLA-DR Ab (BD Bioscience), and anti-LAG-3 Ab (R&D systems). The immunophenotype of HERC1 P3278S reactive and bulk CD8+ T-cells were analyzed. Data were acquired using an LSR II flow cytometer (Becton Dickson) with FASCDiva 6 software.

Intracellular Cytokine Staining (ICS)

HERC1 P>S mutant and wild type peptides of 9 amino acids in length (Mutant: ASNASSAAK (SEQ ID NO: 344), Wild type: ASNAPSAAK (SEQ ID NO: 5925)) were synthesized (GenScript Piscataway, N.J.). 1.5×106 patient PBMCs were cultured with 1.5×106 autologous PBMCs pulsed with HERC1 P>S mutant peptide in RPMI media containing 10% pooled human serum (PHS), 10 mM HEPES, 2 mM L Glutamine, and 50 µM β-mercaptoethanol supplemented with IL-15 (10 ng/ml) and IL-2 (10 IU/ml), using methods previously described (59). Cells were harvested at day 12, stained with 3 µL PE-Cy5-CD107a (BD Pharmingen), and either left unstimulated, or stimulated by the addition of (a) mutant peptide or (b) wild type peptide for 2 hours. Cells were then treated with 1× Brefeldin A and monensin (BioLegend) for 4 hours, and subsequently stained with 1 µL Alexa Fluor 405-CD3 (Invitrogen), 3 µL APC-H7-CD8 (BD Bioscience), and 1 µL ECD-CD4 (Beckman Coulter). Upon subsequent washing and permeabilization, the cells were stained with the following antibodies to intracellular cytokines: 3 µL Alexa Fluor 647-IFN-γ (Biolegend), 3 µL PE-MIP-1β, and 1 µL PE-Cy7-TNF-α (BD Pharmingen). Data were acquired by flow cytometry (using CYAN flow cytometer, Summit software, Dako Cytomation California Inc., Carpinteria, Calif.). Analysis was done by FlowJo version 10.1, TreeStar, Inc. CD3+ single cell lymphocytes were gated for analysis (SS vs. FS [low, mid], FS vs. Pulse Width [all, low], and CD3 vs. "dump" channel [high, low]).

Statistics

Mann-Whitney test was used to compare mutation burdens and differences in the frequency of nucleotide changes. The Log-Rank and Mantel-Haenszel tests were used to compare Kaplan-Meier survival curves. The proportion of objective responders/non-responders or DCB/NDB were compared using Fisher's Exact Test. The receiver operator characteristic (ROC) curve was generated by plotting the proportion of all DCB patients with mutation burden above any given cut point (sensitivity) against the proportion of the NDB patients that would also exceed the same cut point (1-specificity). The area under the curve and exact 95% confidence intervals are reported. Correlations between nonsynonymous mutation burden and neoantigen burden, neoantigen burden and best overall response, and frequency of neoantigen burden/nonsynonymous mutation and best overall response were calculated using Spearman correlation formula. Statistical analyses were performed using GraphPad Prism v.6 (Graphpad Prism Software, San Diego, Calif.).

Example 5

Treatment with Pembrolizumab

This example provides instructions for treatment of a cancer (melanoma) with an antibody immunotherapy (pembrolizumab), as approved by the United States Food & Drug Administration for the treatment of metastatic melanoma. In some embodiments, long term clinical benefit is observed after pembrolizumab treatment.

KEYTRUDA® (pembrolizumab) for injection, for intravenous use Initial U.S. Approval: 2014

------------------------------Indications and Usage---------------------------

KEYTRUDA is a human programmed death receptor-1 (PD-1)-blocking antibody indicated for the treatment of patients with unresectable or metastatic melanoma and disease progression following ipilimumab and, if BRAF V600 mutation positive, a BRAF inhibitor. This indication is approved under accelerated approval based on tumor response rate and durability of response. An improvement in survival or disease-related symptoms has not yet been established. Continued approval for this indication may be contingent upon verification and description of clinical benefit in the confirmatory trials. (1)

----------------------Dosage and Administration----------------------

Administer 2 mg/kg as an intravenous infusion over 30 minutes every 3 weeks. (2.1)

Reconstitute and dilute prior to intravenous infusion. (2.3)

---------------------Dosage Forms and Strengths---------------------

For injection: 50 mg, lyophilized powder in single-use vial for reconstitution (3)

-------------------------------Contraindications-------------------------------

None. (4)

-----------------------Warnings and Precautions-----------------------

Immune-mediated adverse reactions: Administer corticosteroids based on the severity of the reaction. (5.1, 5.2, 5.3, 5.4, 5.5, 5.6)

Immune-mediated pneumonitis: Withhold for moderate, and permanently discontinue for severe or life-threatening pneumonitis. (5.1)

Immune-mediated colitis: Withhold for moderate or severe, and permanently discontinue for life-threatening colitis. (5.2)

Immune-mediated hepatitis: Monitor for changes in hepatic function. Based on severity of liver enzyme elevations, withhold or discontinue. (5.3)

Immune-mediated hypophysitis: Withhold for moderate, withhold or discontinue for severe, and permanently discontinue for life-threatening hypophysitis. (5.4)

Immune-mediated nephritis: Monitor for changes in renal function. Withhold for moderate, and permanently discontinue for severe or life-threatening nephritis. (5.5)

Immune-mediated hyperthyroidism and hypothyroidism: Monitor for changes in thyroid function. Withhold for severe and permanently discontinue for life-threatening hyperthyroidism. (5.6)

Embryofetal Toxicity: KEYTRUDA may cause fetal harm. Advise females of reproductive potential of the potential risk to a fetus. (5.8)

-------------------------------Adverse Reactions-------------------------------

Most common adverse reactions (reported in >20% of patients) included fatigue, cough, nausea, pruritus, rash, decreased appetite, constipation, arthralgia, and diarrhea. (6.1)

To report SUSPECTED ADVERSE REACTIONS, contact Merck Sharp & Dohme Corp., a subsidiary of Merck & Co., Inc., at 1-877888-4231 or FDA at 1-800-FDA-1088 or www.fda.gov/medwatch.

----------------------Use in Specific Populations----------------------

Nursing mothers: Discontinue nursing or discontinue KEYTRUDA. (8.3)

1 Indications and Usage

KEYTRUDA® (pembrolizumab) is indicated for the treatment of patients with unresectable or metastatic melanoma and disease progression following ipilimumab and, if BRAF V600 mutation positive, a BRAF inhibitor [see Clinical Studies (14)].

This indication is approved under accelerated approval based on tumor response rate and durability of response. An improvement in survival or disease-related symptoms has not yet been established. Continued approval for this indication may be contingent upon verification and description of clinical benefit in the confirmatory trials.

2 Dosage and Administration 2.1 Recommended Dosing

The recommended dose of KEYTRUDA is 2 mg/kg administered as an intravenous infusion over 30 minutes every 3 weeks until disease progression or unacceptable toxicity.

2.2 Dose Modifications

Withhold KEYTRUDA for any of the following:

Grade 2 pneumonitis [see Warnings and Precautions (5.1)]

Grade 2 or 3 colitis [see Warnings and Precautions (5.2)]

Symptomatic hypophysitis [see Warnings and Precautions (5.4)]

Grade 2 nephritis [see Warnings and Precautions (5.5)]

Grade 3 hyperthyroidism [see Warnings and Precautions (5.6)]

Aspartate aminotransferase (AST) or alanine aminotransferase (ALT) greater than 3 and up to 5 times upper limit of normal (ULN) or total bilirubin greater than 1.5 and up to 3 times ULN Any other severe or Grade 3 treatment-related adverse reaction [see Warnings and Precautions (5.7)]

Resume KEYTRUDA in patients whose adverse reactions recover to Grade 0-1.

Permanently discontinue KEYTRUDA for any of the following:

Any life-threatening adverse reaction

Grade 3 or 4 pneumonitis [see Warnings and Precautions (5.1)]

Grade 3 or 4 nephritis [see Warnings and Precautions (5.5)]

AST or ALT greater than 5 times ULN or total bilirubin greater than 3 times ULN

For patients with liver metastasis who begin treatment with Grade 2 AST or ALT, if AST or ALT increases by greater than or equal to 50% relative to baseline and lasts for at least 1 week Grade 3 or 4 infusion-related reactions Inability to reduce corticosteroid dose to 10 mg or less of prednisone or equivalent per day within 12 weeks Persistent Grade 2 or 3 adverse reactions that do not recover to Grade 0-1 within 12 weeks after last dose of KEYTRUDA Any severe or Grade 3 treatment-related adverse reaction that recurs [see Warnings and Precautions (5.7)]

2.3 Preparation and Administration

Preparation

Add 2.3 mL of Sterile Water for Injection, USP by injecting the water along the walls of the vial and not directly on the lyophilized powder (resulting concentration 25 mg/mL).

Slowly swirl the vial. Allow up to 5 minutes for the bubbles to clear. Do not shake the vial.

Visually inspect the reconstituted solution for particulate matter and discoloration prior to administration. Reconstituted KEYTRUDA is a clear to slightly opalescent, colorless to slightly yellow solution. Discard reconstituted vial if extraneous particulate matter other than translucent to white proteinaceous particles is observed.

Withdraw the required volume from the vial(s) of KEYTRUDA and transfer into an intravenous (IV) bag containing 0.9% Sodium Chloride Injection, USP. Mix diluted solution by gentle inversion. The final concentration of the diluted solution should be between 1 mg/mL to 10 mg/mL.

Discard any unused portion left in the vial.

Storage of Reconstituted and Diluted Solutions

The product does not contain a preservative. Store the reconstituted and diluted solutions of KEYTRUDA either:

At room temperature for no more than 4 hours from the time of reconstitution. This includes room temperature storage of reconstituted vials, storage of the infusion solution in the IV bag, and the duration of infusion.

Under refrigeration at 2° C. to 8° C. (36° F. to 46° F.) for no more than 24 hours from the time of reconstitution. If refrigerated, allow the diluted solution to come to room temperature prior to administration.

Do not freeze.

Administration

Administer infusion solution intravenously over 30 minutes through an intravenous line containing a sterile, non-pyrogenic, low-protein binding 0.2 micron to 5 micron in-line or add-on filter.

Do not co-administer other drugs through the same infusion line.

3 Dosage Forms and Strengths

For injection: 50 mg lyophilized powder in a single-use vial for reconstitution

4 Contraindications

None.

5 Warnings and Precautions 5.1 Immune-Mediated Pneumonitis

Pneumonitis occurred in 12 (2.9%) of 411 melanoma patients, including Grade 2 or 3 cases in 8 (1.9%) and 1 (0.2%) patients, respectively, receiving KEYTRUDA in Trial 1. The median time to development of pneumonitis was 5 months (range 0.3 weeks-9.9 months). The median duration was 4.9 months (range 1 week-14.4 months). Five of eight patients with Grade 2 and the one patient with Grade 3 pneumonitis required initial treatment with high-dose systemic corticosteroids (greater than or equal to 40 mg prednisone or equivalent per day) followed by a corticosteroid taper. The median initial dose of high-dose corticosteroid treatment was 63.4 mg/day of prednisone or equivalent with a median duration of treatment of 3 days (range 1-34) followed by a corticosteroid taper. Pneumonitis led to discontinuation of KEYTRUDA in 3 (0.7%) patients. Pneumonitis completely resolved in seven of the nine patients with Grade 2-3 pneumonitis. Monitor patients for signs and symptoms of pneumonitis. Evaluate patients with suspected pneumonitis with radiographic imaging and administer corticosteroids for Grade 2 or greater pneumonitis. Withhold KEYTRUDA for moderate (Grade 2) pneumonitis, and permanently discontinue KEYTRUDA for severe (Grade 3) or life-threatening (Grade 4) pneumonitis [see Dosage and Administration (2.2) and Adverse Reactions (6.1)].

5.2 Immune-Mediated Colitis

Colitis (including microscopic colitis) occurred in 4 (1%) of 411 patients, including Grade 2 or 3 cases in 1 (0.2%) and 2 (0.5%) patients, respectively, receiving KEYTRUDA in Trial 1. The median time to onset of colitis was 6.5 months (range 2.3-9.8). The median duration was 2.6 months (range 0.6 weeks-3.6 months). All three patients with Grade 2 or 3 colitis were treated with high-dose corticosteroids (greater than or equal to 40 mg prednisone or equivalent per day) with a median initial dose of 70 mg/day of prednisone or equivalent; the median duration of initial treatment was 7 days (range 4-41), followed by a corticosteroid taper. One patient (0.2%) required permanent discontinuation of KEYTRUDA due to colitis. All four patients with colitis experienced complete resolution of the event. Monitor patients for signs and symptoms of colitis. Administer corticosteroids for Grade 2 or greater colitis. Withhold KEYTRUDA for moderate (Grade 2) or severe (Grade 3) colitis, and permanently discontinue KEYTRUDA for life threatening (Grade 4) colitis [see Dosage and Administration (2.2) and Adverse Reactions (6.1)].

5.3 Immune-Mediated Hepatitis

Hepatitis (including autoimmune hepatitis) occurred in 2 (0.5%) of 411 patients, including a Grade 4 case in 1 (0.2%) patient, receiving KEYTRUDA in Trial 1. The time to onset was 22 days for the case of Grade 4 hepatitis which lasted 1.1 months. The patient with Grade 4 hepatitis permanently discontinued KEYTRUDA and was treated with high-dose (greater than or equal to 40 mg prednisone or equivalent per day) systemic corticosteroids followed by a corticosteroid taper. Both patients with hepatitis experienced complete resolution of the event. Monitor patients for changes in liver function. Administer corticosteroids for Grade 2 or greater hepatitis and, based on severity of liver enzyme elevations, withhold or discontinue KEYTRUDA [see Dosage and Administration (2.2) and Adverse Reactions (6.1)].

5.4 Immune-Mediated Hypophysitis

Hypophysitis occurred in 2 (0.5%) of 411 patients, consisting of one Grade 2 and one Grade 4 case (0.2% each), in patients receiving KEYTRUDA in Trial 1. The time to onset was 1.7 months for the patient with Grade 4 hypophysitis and 1.3 months for the patient with Grade 2 hypophysitis. Both patients were treated with high-dose (greater than or equal to 40 mg prednisone or equivalent per day) corticosteroids followed by a corticosteroid taper and remained on a physiologic replacement dose. Monitor for signs and symptoms of hypophysitis. Administer corticosteroids for Grade 2 or greater hypophysitis. Withhold KEYTRUDA for moderate (Grade 2) hypophysitis, withhold or discontinue KEYTRUDA for severe (Grade 3) hypophysitis, and permanently discontinue KEYTRUDA for lifethreatening (Grade 4) hypophysitis [see Dosage and Administration (2.2) and Adverse Reactions (6.1)].

5.5 Renal Failure and Immune-Mediated Nephritis

Nephritis occurred in 3 (0.7%) patients, consisting of one case of Grade 2 autoimmune nephritis (0.2%) and two cases of interstitial nephritis with renal failure (0.5%), one Grade 3 and one Grade 4. The time to onset of autoimmune nephritis was 11.6 months after the first dose of KEYTRUDA (5 months after the last dose) and lasted 3.2 months; this patient did not have a biopsy. Acute interstitial nephritis was confirmed by renal biopsy in two patients with Grades 3-4 renal failure. All three patients fully recovered renal function with treatment with high-dose corticosteroids (greater than or equal to 40 mg prednisone or equivalent per day) followed by a corticosteroid taper. Monitor patients for changes in renal function. Administer corticosteroids for Grade 2 or greater nephritis. Withhold KEYTRUDA for moderate (Grade 2) nephritis, and permanently discontinue KEYTRUDA for severe (Grade 3), or life-threatening (Grade 4) nephritis [see Dosage and Administration (2.2) and Adverse Reactions (6.1)].

5.6 Immune-Mediated Hyperthyroidism and Hypothyroidism

Hyperthyroidism occurred in 5 (1.2%) of 411 patients, including Grade 2 or 3 cases in 2 (0.5%) and 1 (0.2%) patients, respectively, receiving KEYTRUDA in Trial 1. The median time to onset was 1.5 months (range 0.5-2.1). The median duration was 2.8 months (range 0.9 to 6.1). One of two patients with Grade 2 and the one patient with Grade 3 hyperthyroidism required initial treatment with high-dose corticosteroids (greater than or equal to 40 mg prednisone or equivalent per day) followed by a corticosteroid taper. One patient (0.2%) required permanent discontinuation of KEYTRUDA due to hyperthyroidism. All five patients with hyperthyroidism experienced complete resolution of the event. Hypothyroidism occurred in 34 (8.3%) of 411 patients, including a Grade 3 case in 1 (0.2%) patient, receiving KEYTRUDA in Trial 1. The median time to onset of hypothyroidism was 3.5 months (range 0.7 weeks-19 months). All but two of the patients with hypothyroidism were treated with long-term thyroid hormone replacement therapy. The other two patients only required short-term thyroid hormone replacement therapy. No patient received corticosteroids or discontinued KEYTRUDA for management of hypothyroidism. Thyroid disorders can occur at any time during treatment. Monitor patients for changes in thyroid function (at the start of treatment, periodically during treatment, and as indicated based on clinical evaluation) and for clinical signs and symptoms of thyroid disorders. Administer corticosteroids for Grade 3 or greater hyperthyroidism, withhold KEYTRUDA for severe (Grade 3) hyperthyroidism, and permanently discontinue KEYTRUDA for life-threatening (Grade 4) hyperthyroidism. Isolated hypothyroidism may be managed with replacement therapy without treatment interruption and without corticosteroids [see Dosage and Administration (2.2) and Adverse Reactions (6.1)].

5.7 Other Immune-Mediated Adverse Reactions

Other clinically important immune-mediated adverse reactions can occur. The following clinically significant, immune-mediated adverse reactions occurred in less than 1% of patients treated with KEYTRUDA in Trial 1: exfoliative dermatitis, uveitis, arthritis, myositis, pancreatitis, hemolytic anemia, partial seizures arising in a patient with inflammatory foci in brain parenchyma, and adrenal insufficiency.

Across clinical studies with KEYTRUDA in approximately 2000 patients, the following additional clinically significant, immune-mediated adverse reactions were reported in less than 1% of patients: myasthenic syndrome, optic neuritis, and rhabdomyolysis.

For suspected immune-mediated adverse reactions, ensure adequate evaluation to confirm etiology or exclude other causes. Based on the severity of the adverse reaction, withhold KEYTRUDA and administer corticosteroids. Upon improvement to Grade 1 or less, initiate corticosteroid taper and continue to taper over at least 1 month. Restart KEYTRUDA if the adverse reaction remains at Grade 1 or less. Permanently discontinue KEYTRUDA for any severe or Grade 3 immune-mediated adverse reaction that recurs and for any life-threatening immune-mediated adverse reaction [see Dosage and Administration (2.2) and Adverse Reactions (6.1)].

5.8 Embryofetal Toxicity

Based on its mechanism of action, KEYTRUDA may cause fetal harm when administered to a pregnant woman. Animal models link the PD-1/PDL-1 signaling pathway with maintenance of pregnancy through induction of maternal immune tolerance to fetal tissue. If this drug is used during pregnancy, or if the patient becomes pregnant while taking this drug, apprise the patient of the potential hazard to a fetus. Advise females of reproductive potential to use highly effective contraception during treatment with KEYTRUDA and for 4 months after the last dose of KEYTRUDA [see Use in Specific Populations (8.1, 8.8)].

EQUIVALENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

REFERENCES

1. W. B. Coley, The treatment of malignant tumors by repeated inoculations of erysipelas. With a report of ten original cases. 1893. Clinical Orthopaedics and Related Research, 3-11 (1991); published online EpubJan.
2. F. S. Hodi, S. J. O'Day, D. F. McDermott, R. W. Weber, J. A. Sosman, J. B. Haanen, R. Gonzalez, C. Robert, D. Schadendorf, J. C. Hassel, W. Akerley, A. J. van den Eertwegh, J. Lutzky, P. Lorigan, J. M. Vaubel, G. P. Linette, D. Hogg, C. H. Ottensmeier, C. Lebbe, C. Peschel, I. Quirt, J. I. Clark, J. D. Wolchok, J. S. Weber, J. Tian, M. J. Yellin, G. M. Nichol, A. Hoos, W. J. Urba, Improved survival with ipilimumab in patients with metastatic melanoma. The New England Journal of Medicine 363, 711-723 (2010); published online EpubAug 19 (10.1056/NEJMoa1003466).
3. S. L. Topalian, F. S. Hodi, J. R. Brahmer, S. N. Gettinger, D. C. Smith, D. F. McDermott, J. D. Powderly, R. D. Carvajal, J. A. Sosman, M. B. Atkins, P. D. Leming, D. R. Spigel, S. J. Antonia, L. Horn, C. G. Drake, D. M. Pardoll, L. Chen, W. H. Sharfman, R. A. Anders, J. M. Taube, T. L. McMiller, H. Xu, A. J. Korman, M. Jure-Kunkel, S. Agrawal, D. McDonald, G. D. Kollia, A. Gupta, J. M. Wigginton, M. Sznol, Safety, activity, and immune correlates of anti-PD-1 antibody in cancer. The New England Journal of Medicine 366, 2443-2454 (2012); published online EpubJun 28 (10.1056/NEJMoa1200690).
4. J. D. Wolchok, H. Kluger, M. K. Callahan, M. A. Postow, N. A. Rizvi, A. M. Lesokhin, N. H. Segal, C. E. Ariyan, R. A. Gordon, K. Reed, M. M. Burke, A. Caldwell, S. A. Kronenberg, B. U. Agunwamba, X. Zhang, I. Lowy, H. D. Inzunza, W. Feely, C. E. Horak, Q. Hong, A. J. Korman, J. M. Wigginton, A. Gupta, M. Sznol, Nivolumab plus ipilimumab in advanced melanoma. The New England Journal of Medicine 369, 122-133 (2013); published online EpubJul 11 (10.1056/NEJMoa1302369).
5. C. Robert, A. Ribas, J. D. Wolchok, F. S. Hodi, O. Hamid, R. Kefford, J. S. Weber, A. M. Joshua, W. J. Hwu, T. C. Gangadhar, A. Patnaik, R. Dronca, H. Zarour, R. W. Joseph, P. Boasberg, B. Chmielowski, C. Mateus, M. A. Postow, K. Gergich, J. Elassaiss-Schaap, X. N. Li, R. Iannone, S. W. Ebbinghaus, S. P. Kang, A. Daud, Anti-programmed-death-receptor-1 treatment with pembrolizumab in ipilimumab-refractory advanced melanoma: a randomised dose-comparison cohort of a phase 1 trial. Lancet 384, 1109-1117 (2014); published online EpubSep 20 (10.1016/S0140-6736(14)60958-2).
6. E. B. Garon, L. Gandhi, N. Rizvi, R. Hui, A. S. Balmanoukian, A. Patnaik, J. P. Eder, G. R. Blumenshein, C. Aggarwal, J.-C. Soria, M. A. Ahn, M. A. Gubens, S. S. Ramalingam, E. Johnson, H. Arkenau, G. M. Lubiniecki, J. Zhang, R. Z. Rutledge, K. Emancipator, N. Leighl, ANTITUMOR ACTIVITY OF PEMBROLIZUMAB (PEMBRO; MK-3475) AND CORRELATION WITH PROGRAMMED DEATH LIGAND 1 (PD-L1) EXPRESSION IN A POOLED ANALYSIS OF PATIENTS (PTS) WITH ADVANCED NON-SMALL CELL LUNG CARCINOMA (NSCLC). Annals of Oncology 25, LBA43 (2014); published online Epub-Sep.1, 2014 (10.1093/annonc/mdu438.51).
7. G. P. Pfeifer, Y. H. You, A. Besaratinia, Mutations induced by ultraviolet light. Mutation Research 571, 19-31 (2005); published online EpubApr 1 (10.1016/j.mrfmmm.2004.06.057).
8. G. P. Pfeifer, M. F. Denissenko, M. Olivier, N. Tretyakova, S. S. Hecht, P. Hainaut, Tobacco smoke carcinogens, DNA damage and p53 mutations in smoking-associated cancers. Oncogene 21, 7435-7451 (2002); published online EpubOct 21 (10.1038/sj.onc.1205803).
9. M. S. Lawrence, P. Stojanov, P. Polak, G. V. Kryukov, K. Cibulskis, A. Sivachenko, S. L. Carter, C. Stewart, C. H. Mermel, S. A. Roberts, A. Kiezun, P. S. Hammerman, A. McKenna, Y. Drier, L. Zou, A. H. Ramos, T. J. Pugh, N. Stransky, E. Helman, J. Kim, C. Sougnez, L. Ambrogio, E. Nickerson, E. Shefler, M. L. Cortes, D. Auclair, G. Saksena, D. Voet, M. Noble, D. DiCara, P. Lin, L. Lichtenstein, D. I. Heiman, T. Fennell, M. Imielinski, B. Hernandez, E. Hodis, S. Baca, A. M. Dulak, J. Lohr, D. A. Landau, C. J. Wu, J. Melendez-Zajgla, A. Hidalgo-Miranda, A. Koren, S. A. McCarroll, J. Mora, R. S. Lee, B. Crompton, R. Onofrio, M. Parkin, W. Winckler, K. Ardlie, S. B. Gabriel, C. W. Roberts, J. A. Biegel, K. Stegmaier, A. J. Bass, L. A. Garraway, M. Meyerson, T. R. Golub, D. A. Gordenin, S. Sunyaev, E. S. Lander, G. Getz, Mutational heterogeneity in cancer and the search for new cancer-associated genes. Nature 499, 214-218 (2013); published online EpubJul 11 (10.1038/nature12213).
10. L. B. Alexandrov, S. Nik-Zainal, D. C. Wedge, S. A. Aparicio, S. Behjati, A. V. Biankin, G. R. Bignell, N. Bolli, A. Borg, A. L. Borresen-Dale, S. Boyault, B. Burkhardt, A. P. Butler, C. Caldas, H. R. Davies, C. Desmedt, R. Eils, J. E. Eyfjord, J. A. Foekens, M. Greaves, F. Hosoda, B. Hutter, T. Ilicic, S. Imbeaud, M. Imielinski, N. Jager, D. T. Jones, D. Jones, S. Knappskog, M. Kool, S. R. Lakhani, C. Lopez-Otin, S. Martin, N. C. Munshi, H. Nakamura, P. A. Northcott, M. Pajic, E. Papaemmanuil, A. Paradiso, J. V. Pearson, X. S. Puente, K. Raine, M. Ramakrishna, A. L. Richardson, J. Richter, P. Rosenstiel, M. Schlesner, T. N. Schumacher, P. N. Span, J. W. Teague, Y. Totoki, A. N. Tutt, R. Valdes-Mas, M. M. van Buuren, L. van 't Veer, A. Vincent-Salomon, N. Waddell, L. R. Yates, I. Australian Pancreatic Cancer Genome, I. B. C. Consortium, I. M.-S. Consortium, I. PedBrain, J. Zucman-Rossi, P. A. Futreal, U. McDermott, P. Lichter, M. Meyerson, S. M. Grimmond, R. Siebert, E. Campo, T. Shibata, S. M. Pfister, P. J. Campbell, M. R. Stratton, Signatures of mutational processes in human cancer. Nature 500, 415-421 (2013); published online EpubAug 22 (10.1038/nature12477).
11. B. Vogelstein, N. Papadopoulos, V. E. Velculescu, S. Zhou, L. A. Diaz, Jr., K. W. Kinzler, Cancer genome landscapes. Science 339, 1546-1558 (2013); published online EpubMar 29 (10.1126/science.1235122).
12. R. Govindan, L. Ding, M. Griffith, J. Subramanian, N. D. Dees, K. L. Kanchi, C. A. Maher, R. Fulton, L. Fulton, J. Wallis, K. Chen, J. Walker, S. McDonald, R. Bose, D. Ornitz, D. H. Xiong, M. You, D. J. Dooling, M. Watson, E. R. Mardis, R. K. Wilson, Genomic Landscape of Non-Small Cell Lung Cancer in Smokers and Never-Smokers. Cell 150, 1121-1134 (2012); published online EpubSep 14 (DOI 10.1016/j.cell.2012.08.024).
13. P. S. Hammerman, M. S. Lawrence, D. Voet, R. Jing, K. Cibulskis, A. Sivachenko, P. Stojanov, A. McKenna, E. S. Lander, S. Gabriel, G. Getz, C. Sougnez, M. Imielinski, E. Helman, B. Hernandez, N. H. Pho, M. Meyerson, A. Chu, H. J. E. Chun, A. J. Mungall, E. Pleasance, A. G. Robertson, P. Sipahimalani, D. Stoll, M. Balasundaram, I. Birol, Y. S. N. Butterfield, E. Chuah, R. J. N. Coope, R. Corbett, N. Dhalla, R. Guin, A. C. Hirst, M. Hirst, R. A. Holt, D. Lee, H. I. Li, M. Mayo, R. A. Moore, K. Mungall, K. M. Nip, A. Olshen, J. E. Schein, J. R. Slobodan, A. Tam, N. Thiessen, R. Varhol, T. Zeng, Y. Zhao, S. J. M. Jones, M. A. Marra, G. Saksena, A. D. Cherniack, S. E. Schumacher, B. Tabak, S. L. Carter, N. H. Pho, H. Nguyen, R. C. Onofrio, A. Crenshaw, K. Ardlie, R. Beroukhim, W. Winckler, P. S. Hammerman, G. Getz, M. Meyerson, A. Protopopov, J. H. Zhang, A. Hadjipanayis, S. Lee, R. B. Xi, L. X. Yang, X. J. Ren, H. L. Zhang, S. Shukla, P. C. Chen, P. Haseley, E. Lee, L. Chin, P. J. Park, R. Kucherlapati, N. D. Socci, Y. P. Liang, N. Schultz, L. Borsu, A. E. Lash, A. Viale, C. Sander, M. Ladanyi, J. T. Auman, K. A. Hoadley, M. D. Wilkerson, Y. Shi, C. Liguori, S. W. Meng, L. Li, Y. J. Turman, M. D. Topal, D. H. Tan, S. Waring, E. Buda, J. Walsh, C. D. Jones, P. A. Mieczkowski, D. Singh, J. Wu, A. Gulabani, P. Dolina, T. Bodenheimer, A. P. Hoyle, J. V. Simons, M. G. Soloway, L. E. Mose, S. R. Jefferys, S. Balu, B. D. O'Connor, J. F. Prins, J. Liu, D. Y. Chiang, D. N. Hayes, C. M. Perou, L. Cope, L. Danilova, D. J. Weisenberger, D. T. Maglinte, F. Pan, D. J. den Berg, T. Triche, J. G. Herman, S. B. Baylin, P. W. Laird, G. Getz, M. Noble, D. Voet, G. Saksena, N. Gehlenborg, D. DiCara, J. H. Zhang, H. L. Zhang, C. J. Wu, S. Y. Liu, M. S. Lawrence, L. H. Zou, A. Sivachenko, P. Lin, P. Stojanov, R. Jing, J. Cho, M. D. Nazaire, J. Robinson, H. Thorvaldsdottir, J. Mesirov, P. J. Park, L. Chin, N. Schultz, R. Sinha, G. Ciriello, E. Cerami, B. Gross, A. Jacobsen, J. Gao, B. A. Aksoy, N. Weinhold, R. Ramirez, B. S. Taylor, Y. Antipin, B. Reva, R. L. Shen, Q. Mo, V. Seshan, P. K. Paik, M. Ladanyi, C. Sander, R. Akbani, N. X. Zhang, B. M. Broom, T. Casasent, A. Unruh, C. Wakefield, R. C. Cason, K. A. Baggerly, J. N. Weinstein, D. Haussler, C. C. Benz, J. M. Stuart, J. C. Zhu, C. Szeto, G. K. Scott, C. Yau, S. Ng, T. Goldstein, P. Waltman, A. Sokolov, K. Ellrott, E. A. Collisson, D. Zerbino, C. Wilks, S. Ma, B. Craft, M. D. Wilkerson, J. T. Auman, K. A. Hoadley, Y. Du, C. Cabanski, V. Walter, D. Singh, J. Y. Wu, A. Gulabani, T. Bodenheimer, A. P. Hoyle, J. V. Simons, M. G. Soloway, L. E. Mose, S. R.

Jefferys, S. Balu, J. S. Marron, Y. Liu, K. Wang, J. Liu, J. F. Prins, D. N. Hayes, C. M. Perou, C. J. Creighton, Y. Q. Zhang, W. D. Travis, N. Rekhtman, J. Yi, M. C. Aubry, R. Cheney, S. Dacic, D. Flieder, W. Funkhouser, P. Illei, J. Myers, M. S. Tsao, R. Penny, D. Mallery, T. Shelton, M. Hatfield, S. Morris, P. Yena, C. Shelton, M. Sherman, J. Paulauskis, M. Meyerson, S. B. Baylin, R. Govindan, R. Akbani, I. Azodo, D. Beer, R. Bose, L. A. Byers, D. Carbone, L. W. Chang, D. Chiang, A. Chu, E. Chun, E. Collisson, L. Cope, C. J. Creighton, L. Danilova, L. Ding, G. Getz, P. S. Hammerman, D. N. Hayes, B. Hernandez, J. G. Herman, J. Heymach, C. Ida, M. Imielinski, B. Johnson, I. Jurisica, J. Kaufman, F. Kosari, R. Kucherlapati, D. Kwiatkowski, M. Ladanyi, M. S. Lawrence, C. A. Maher, A. Mungall, S. Ng, W. Pao, M. Peifer, R. Penny, G. Robertson, V. Rusch, C. Sander, N. Schultz, R. L. Shen, J. Siegfried, R. Sinha, A. Sivachenko, C. Sougnez, D. Stoll, J. Stuart, R. K. Thomas, S. Tomaszek, M. S. Tsao, W. D. Travis, C. Vaske, J. N. Weinstein, D. Weisenberger, D. Wheeler, D. A. Wigle, M. D. Wilkerson, C. Wilks, P. Yang, J. J. Zhang, M. A. Jensen, R. Sfeir, A. B. Kahn, A. L. Chu, P. Kothiyal, Z. Wang, E. E. Snyder, J. Pontius, T. D. Pihl, B. Ayala, M. Backus, J. Walton, J. Baboud, D. L. Berton, M. C. Nicholls, D. Srinivasan, R. Raman, S. Girshik, P. A. Kigonya, S. Alonso, R. N. Sanbhadti, S. P. Barletta, J. M. Greene, D. A. Pot, M. S. Tsao, B. Bandarchi-Chamkhaleh, J. Boyd, J. Weaver, D. A. Wigle, I. A. Azodo, S. C. Tomaszek, M. C. Aubry, C. M. Ida, P. Yang, F. Kosari, M. V. Brock, K. Rogers, M. Rutledge, T. Brown, B. Lee, J. Shin, D. Trusty, R. Dhir, J. M. Siegfried, O. Potapova, K. V. Fedosenko, E. Nemirovich-Danchenko, V. Rusch, M. Zakowski, M. V. Iacocca, J. Brown, B. Rabeno, C. Czerwinski, N. Petrelli, Z. Fan, N. Todaro, J. Eckman, J. Myers, W. K. Rathmell, L. B. Thorne, M. Huang, L. Boice, A. Hill, R. Penny, D. Mallery, E. Curley, C. Shelton, P. Yena, C. Morrison, C. Gaudioso, J. S. Bartlett, S. Kodeeswaran, B. Zanke, H. Sekhon, K. David, H. Juhl, X. Van Le, B. Kohl, R. Thorp, N. V. Tien, N. Van Bang, H. Sussman, B. D. Phu, R. Hajek, N. PhiHung, K. Z. Khan, T. Muley, K. R. M. Shaw, M. Sheth, L. Yang, K. Buetow, T. Davidsen, J. A. Demchok, G. Eley, M. Ferguson, L. A. L. Dillon, C. Schaefer, M. S. Guyer, B. A. Ozenberger, J. D. Palchik, J. Peterson, H. J. Sofia, E. Thomson, M. Meyerson, C. G. A. R. Network, Comprehensive genomic characterization of squamous cell lung cancers. Nature 489, 519-525 (2012); published online EpubSep 27 (Doi 10.1038/Nature11404).

14. The Cancer Genome Atlas Research Network, Comprehensive molecular profiling of lung adenocarcinoma. Nature 511, 543-550 (2014); published online EpubJul 31 (10.1038/nature13385).

15. O. D. Abaan, E. C. Polley, S. R. Davis, Y. J. Zhu, S. Bilke, R. L. Walker, M. Pineda, Y. Gindin, Y. Jiang, W. C. Reinhold, S. L. Holbeck, R. M. Simon, J. H. Doroshow, Y. Pommier, P. S. Meltzer, The exomes of the NCI-60 panel: a genomic resource for cancer biology and systems pharmacology. Cancer Research 73, 4372-4382 (2013); published online EpubJul 15 (10.1158/0008-5472.CAN-12-3342).

16. D. Hoffmann, I. Hoffmann, K. El-Bayoumy, The less harmful cigarette: a controversial issue. a tribute to Ernst L. Wynder. Chemical Research in Toxicology 14, 767-790 (2001); published online EpubJul 17. R. Hindges, U. Hubscher, DNA polymerase delta, an essential enzyme for DNA transactions. Biological Chemistry 378, 345-362 (1997); published online EpubMay 18. C. Palles, J. B. Cazier, K. M. Howarth, E. Domingo, A. M. Jones, P. Broderick, Z. Kemp, S. L. Spain, E. Guarino, I. Salguero, A. Sherborne, D. Chubb, L. G. Carvajal-Carmona, Y. Ma, K. Kaur, S. Dobbins, E. Barclay, M. Gorman, L. Martin, M. B. Kovac, S. Humphray, C. Consortium, W. G. S. Consortium, A. Lucassen, C. C. Holmes, D. Bentley, P. Donnelly, J. Taylor, C. Petridis, R. Roylance, E. J. Sawyer, D. J. Kerr, S. Clark, J. Grimes, S. E. Kearsey, H. J. Thomas, G. McVean, R. S. Houlston, I. Tomlinson, Germline mutations affecting the proofreading domains of POLE and POLD1 predispose to colorectal adenomas and carcinomas. Nature Genetics 45, 136-144 (2013); published online EpubFeb (10.1038/ng.2503).

19. J. F. Goodwin, K. E. Knudsen, Beyond DNA Repair: DNA-PK Function in Cancer. Cancer Discovery 4, 1126-1139 (2014); published online EpubOct (10.1158/2159-8290.CD-14-0358).

20. X. Wang, L. Zou, H. Zheng, Q. Wei, S. J. Elledge, L. Li, Genomic instability and endoreduplication triggered by RAD17 deletion. Genes & Development 17, 965-970 (2003); published online EpubApr 15 (10.1101/gad.1065103).

21. S. Dogan, R. Shen, D. C. Ang, M. L. Johnson, S. P. D'Angelo, P. K. Paik, E. B. Brzostowski, G. J. Riely, M. G. Kris, M. F. Zakowski, M. Ladanyi, Molecular epidemiology of EGFR and KRAS mutations in 3,026 lung adenocarcinomas: higher susceptibility of women to smoking-related KRAS-mutant cancers. Clinical Cancer Research 18, 6169-6177 (2012); published online EpubNov 15 (10.1158/1078-0432.CCR-11-3265).

22. A. S. Charen, V. Makarov, T. Merghoub, L. Walsh, J. Yuan, M. Miller, K. Kannan, M. A. Postow, C. Elipenahli, C. Liu, J. D. Wolchok, T. A. Chan, The neoantigen landscape underlying clinical response to ipilimumab. J Clin Oncol 31, 3003 (2014).

23. M. Nielsen, C. Lundegaard, P. Worning, S. L. Lauemoller, K. Lamberth, S. Buus, S. Brunak, O. Lund, Reliable prediction of T-cell epitopes using neural networks with novel sequence representations. Protein Science 12, 1007-1017 (2003); published online EpubMay (10.1110/ps.0239403).

24. C. Lundegaard, K. Lamberth, M. Harndahl, S. Buus, O. Lund, M. Nielsen, NetMHC-3.0: accurate web accessible predictions of human, mouse and monkey MHC class I affinities for peptides of length 8-11. Nucleic Acids Research 36, W509-512 (2008); published online EpubJul 1 (10.1093/nar/gkn202).

25. M. Rajasagi, S. A. Shukla, E. F. Fritsch, D. B. Keskin, D. DeLuca, E. Carmona, W. Zhang, C. Sougnez, K. Cibulskis, J. Sidney, K. Stevenson, J. Ritz, D. Neuberg, V. Brusic, S. Gabriel, E. S. Lander, G. Getz, N. Hacohen, C. J. Wu, Systematic identification of personal tumor-specific neoantigens in chronic lymphocytic leukemia. Blood 124, 453-462 (2014); published online EpubJul 17 (10.1182/blood-2014-04-567933).

26. B. Rodenko, M. Toebes, S. R. Hadrup, W. J. van Esch, A. M. Molenaar, T. N. Schumacher, H. Ovaa, Generation of peptide-MHC class I complexes through UV-mediated ligand exchange. Nature Protocols 1, 1120-1132 (2006) 10.1038/nprot.2006.121).

27. R. S. Andersen, P. Kvistborg, T. M. Frosig, N. W. Pedersen, R. Lyngaa, A. H. Bakker, C. J. Shu, P. Straten, T. N. Schumacher, S. R. Hadrup, Parallel detection of antigen-specific T cell responses by combinatorial encod- 28. J. M. Taube, A. Klein, J. R. Brahmer, H. Xu, X. Pan, J. H. Kim, L. Chen, D. M. Pardoll, S. L. Topalian, R. A. Anders, Association of PD-1, PD-1 Ligands, and Other Features of the Tumor Immune Microenvironment with Response to Anti-PD-1 Therapy. Clinical Cancer Research 20, 5064-5074 (2014); published online EpubOct 1 (10.1158/1078-0432.CCR-13-3271).

29. R. D. Schreiber, L. J. Old, M. J. Smyth, Cancer immunoediting: integrating immunity's roles in cancer suppression and promotion. Science 331, 1565-1570 (2011); published online EpubMar 25 (10.1126/science.1203486).

30. T. Matsutake, P. K. Srivastava, The immunoprotective MHC II epitope of a chemically induced tumor harbors a unique mutation in a ribosomal protein. Proceedings of the National Academy of Sciences of the United States of America 98, 3992-3997 (2001); published online EpubMar 27 (10.1073/pnas.071523398).

31. H. Matsushita, M. D. Vesely, D. C. Koboldt, C. G. Rickert, R. Uppaluri, V. J. Magrini, C. D. Arthur, J. M. White, Y. S. Chen, L. K. Shea, J. Hundal, M. C. Wendl, R. Demeter, T. Wylie, J. P. Allison, M. J. Smyth, L. J. Old, E. R. Mardis, R. D. Schreiber, Cancer exome analysis reveals a T-cell-dependent mechanism of cancer immunoediting. Nature 482, 400-404 (2012); published online EpubFeb 16 (10.1038/nature10755).

32. J. C. Castle, S. Kreiter, J. Diekmann, M. Lower, N. van de Roemer, J. de Graaf, A. Selmi, M. Diken, S. Boegel, C. Paret, M. Koslowski, A. N. Kuhn, C. M. Britten, C. Huber, O. Tureci, U. Sahin, Exploiting the mutanome for tumor vaccination. Cancer Research 72, 1081-1091 (2012); published online EpubMar 1 (10.1158/0008-5472.CAN-11-3722).

33. T. Schumacher, L. Bunse, S. Pusch, F. Sahm, B. Wiestler, J. Quandt, O. Menn, M. Osswald, I. Oezen, M. Ott, M. Keil, J. Balss, K. Rauschenbach, A. K. Grabowska, I. Vogler, J. Diekmann, N. Trautwein, S. B. Eichmuller, J. Okun, S. Stevanovic, A. B. Riemer, U. Sahin, M. A. Friese, P. Beckhove, A. von Deimling, W. Wick, M. Platten, A vaccine targeting mutant IDH1 induces antitumour immunity. Nature 512, 324-327 (2014); published online EpubAug 21 (10.1038/nature13387).

34. P. F. Robbins, Y. C. Lu, M. El-Gamil, Y. F. Li, C. Gross, J. Gartner, J. C. Lin, J. K. Teer, P. Cliften, E. Tycksen, Y. Samuels, S. A. Rosenberg, Mining exomic sequencing data to identify mutated antigens recognized by adoptively transferred tumor-reactive T cells. Nature Medicine 19, 747-752 (2013); published online EpubJun (10.1038/nm.3161).

35. N. van Rooij, M. M. van Buuren, D. Philips, A. Velds, M. Toebes, B. Heemskerk, L. J. van Dijk, S. Behjati, H. Hilkmann, D. El Atmioui, M. Nieuwland, M. R. Stratton, R. M. Kerkhoven, C. Kesmir, J. B. Haanen, P. Kvistborg, T. N. Schumacher, Tumor exome analysis reveals neoantigen-specific T-cell reactivity in an ipilimumab-responsive melanoma. J Clin Oncol 31, e439-442 (2013); published online EpubNov 10 (10.1200/JCO.2012.47.7521).

36. E. Tran, S. Turcotte, A. Gros, P. F. Robbins, Y. C. Lu, M. E. Dudley, J. R. Wunderlich, R. P. Somerville, K. Hogan, C. S. Hinrichs, M. R. Parkhurst, J. C. Yang, S. A. Rosenberg, Cancer immunotherapy based on mutation-specific CD4+ T cells in a patient with epithelial cancer. Science 344, 641-645 (2014); published online EpubMay 9 (10.1126/science.1251102).

37. J. D. Wolchok, A. Hoos, S. O'Day, J. S. Weber, O. Hamid, C. Lebbe, M. Maio, M. Binder, O. Bohnsack, G. Nichol, R. Humphrey, F. S. Hodi, Guidelines for the evaluation of immune therapy activity in solid tumors: immune-related response criteria. Clinical Cancer Research 15, 7412-7420 (2009); published online EpubDec 1 (10.1158/1078-0432.CCR-09-1624).

38. C. Liu, X. Yang, B. Duffy, T. Mohanakumar, R. D. Mitra, M. C. Zody, J. D. Pfeifer, ATHLATES: accurate typing of human leukocyte antigen through exome sequencing. Nucleic Acids Research 41, e142 (2013); published online EpubAug (10.1093/nar/gkt481).

39. H. Li, R. Durbin, Fast and accurate short read alignment with Burrows-Wheeler transform. Bioinformatics 25, 1754-1760 (2009); published online EpubJul 15 (10.1093/bioinformatics/btp324).

40. M. A. DePristo, E. Banks, R. Poplin, K. V. Garimella, J. R. Maguire, C. Hartl, A. A. Philippakis, G. del Angel, M. A. Rivas, M. Hanna, A. McKenna, T. J. Fennell, A. M. Kernytsky, A. Y. Sivachenko, K. Cibulskis, S. B. Gabriel, D. Altshuler, M. J. Daly, A framework for variation discovery and genotyping using next-generation DNA sequencing data. Nature Genetics 43, 491-498 (2011); published online EpubMay (10.1038/ng.806).

41. G. De Baets, J. Van Durme, J. Reumers, S. Maurer-Stroh, P. Vanhee, J. Dopazo, J. Schymkowitz, F. Rousseau, SNPeffect 4.0: on-line prediction of molecular and structural effects of protein-coding variants. Nucleic Acids Res 40, D935-939 (2012); published online EpubJan (10.1093/nar/gkr996).

42. D. E. Larson, C. C. Harris, K. Chen, D. C. Koboldt, T. E. Abbott, D. J. Dooling, T. J. Ley, E. R. Mardis, R. K. Wilson, L. Ding, SomaticSniper: identification of somatic point mutations in whole genome sequencing data. Bioinformatics 28, 311-317 (2012); published online EpubFeb 1 (10.1093/bioinformatics/btr665).

43. D. C. Koboldt, Q. Zhang, D. E. Larson, D. Shen, M. D. McLellan, L. Lin, C. A. Miller, E. R. Mardis, L. Ding, R. K. Wilson, VarScan 2: somatic mutation and copy number alteration discovery in cancer by exome sequencing. Genome Res. 22, 568-576 (2012); published online EpubMar (10.1101/gr.129684.111).

44. C. T. Saunders, W. S. Wong, S. Swamy, J. Becq, L. J. Murray, R. K. Cheetham, Strelka: accurate somatic small-variant calling from sequenced tumor-normal sample pairs. Bioinformatics 28, 1811-1817 (2012); published online EpubJul 15 (10.1093/bioinformatics/bts271).

45. K. Cibulskis, M. S. Lawrence, S. L. Carter, A. Sivachenko, D. Jaffe, C. Sougnez, S. Gabriel, M. Meyerson, E. S. Lander, G. Getz, Sensitive detection of somatic point mutations in impure and heterogeneous cancer samples. Nat. Biotechnol. 31, 213-219 (2013); published online EpubMar (10.1038/nbt.2514).

46. S. T. Sherry, M. Ward, K. Sirotkin, dbSNP-database for single nucleotide polymorphisms and other classes of minor genetic variation. Genome Research 9, 677-679 (1999).

47. E. V. Server, NHLBI GO Exome Sequencing Project (ESP). http://evs.qs.washington.edu/EVS 48. M. Via, C. Gignoux, E. G. Burchard, The 1000 Genomes Project: new opportunities for research and social challenges. Genome Medicine 2, 3 (2010)10.1186/gm124).

49. J. T. Robinson, H. Thorvaldsdottir, W. Winckler, M. Guttman, E. S. Lander, G. Getz, J. P. Mesirov, Integrative genomics viewer. Nature Biotechnology 29, 24-26 (2011); published online EpubJan (10.1038/nbt.1754).

50. P. Kumar, S. Henikoff, P. C. Ng, Predicting the effects of coding non-synonymous variants on protein function using the SIFT algorithm. Nat. Protoc. 4, 1073-1081 (2009)10.1038/nprot.2009.86).

51. I. A. Adzhubei, S. Schmidt, L. Peshkin, V. E. Ramensky, A. Gerasimova, P. Bork, A. S. Kondrashov, S. R. Sunyaev, A method and server for predicting damaging missense mutations. Nature Methods 7, 248-249 (2010); published online EpubApr (10.1038/nmeth0410-248).

52. X. Liu, X. Jian, E. Boerwinkle, dbNSFP v2.0: a database of human non-synonymous SNVs and their functional predictions and annotations. Human Mutation 34, E2393-2402 (2013); published online EpubSep (10.1002/humu.22376).

53. A. S. Ho, K. Kannan, D. M. Roy, L. G. Morris, I. Ganly, N. Katabi, D. Ramaswami, L. A. Walsh, S. Eng, J. T. Huse, J. Zhang, I. Dolgalev, K. Huberman, A. Heguy, A. Viale, M. Drobnjak, M. A. Leversha, C. E. Rice, B. Singh, N. G. Iyer, C. R. Leemans, E. Bloemena, R. L. Ferris, R. R. Seethala, B. E. Gross, Y. Liang, R. Sinha, L. Peng, B. J. Raphael, S. Turcan, Y. Gong, N. Schultz, S. Kim, S. Chiosea, J. P. Shah, C. Sander, W. Lee, T. A. Chan, The mutational landscape of adenoid cystic carcinoma. Nature Genetics 45, 791-798 (2013); published online EpubJul (10.1038/ng.2643).

54. M. Imielinski, A. H. Berger, P. S. Hammerman, B. Hernandez, T. J. Pugh, E. Hodis, J. Cho, J. Suh, M. Capelletti, A. Sivachenko, C. Sougnez, D. Auclair, M. S. Lawrence, P. Stojanov, K. Cibulskis, K. Choi, L. de Waal, T. Sharifnia, A. Brooks, H. Greulich, S. Banerji, T. Zander, D. Seidel, F. Leenders, S. Ansen, C. Ludwig, W. Engel-Riedel, E. Stoelben, J. Wolf, C. Goparju, K. Thompson, W. Winckler, D. Kwiatkowski, B. E. Johnson, P. A. Janne, V. A. Miller, W. Pao, W. D. Travis, H. I. Pass, S. B. Gabriel, E. S. Lander, R. K. Thomas, L. A. Garraway, G. Getz, M. Meyerson, Mapping the hallmarks of lung adenocarcinoma with massively parallel sequencing. Cell 150, 1107-1120 (2012); published online EpubSep 14 (10.1016/j.cell.2012.08.029).

55. M. Nielsen, C. Lundegaard, P. Worning, C. S. Hvid, K. Lamberth, S. Buus, S. Brunak, O. Lund, Improved prediction of WIC class I and class II epitopes using a novel Gibbs sampling approach. Bioinformatics 20, 1388-1397 (2004); published online EpubJun 12 (10.1093/bioinformatics/bth100).

56. M. Nielsen, C. Lundegaard, O. Lund, C. Kesmir, The role of the proteasome in generating cytotoxic T-cell epitopes: insights obtained from improved predictions of proteasomal cleavage. Immunogenetics 57, 33-41 (2005); published online EpubApr (10.1007/s00251-005-0781-7).

57. C. Lundegaard, O. Lund, M. Nielsen, Accurate approximation method for prediction of class I MHC affinities for peptides of length 8, 10 and 11 using prediction tools trained on 9mers. Bioinformatics 24, 1397-1398 (2008); published online EpubJun 1 (10.1093/bioinformatics/btn128).

58. M. Toebes, M. Coccoris, A. Bins, B. Rodenko, R. Gomez, N. J. Nieuwkoop, W. van de Kasteele, G. F. Rimmelzwaan, J. B. Haanen, H. Ovaa, T. N. Schumacher, Design and use of conditional MEW class I ligands. Nature Medicine 12, 246-251 (2006); published online EpubFeb (10.1038/nm1360).

59. J. Yuan, S. Gnjatic, H. Li, S. Powel, H. F. Gallardo, E. Ritter, G. Y. Ku, A. A. Jungbluth, N. H. Segal, T. S. Rasalan, G. Manukian, Y. Xu, R. A. Roman, S. L. Terzulli, M. Heywood, E. Pogoriler, G. Ritter, L. J. Old, J. P. Allison, J. D. Wolchok, CTLA-4 blockade enhances polyfunctional NY-ESO-1 specific T cell responses in metastatic melanoma patients with clinical benefit. Proceedings of the National Academy of Sciences of the United States of America 105, 20410-20415 (2008); published online EpubDec 23 (10.1073/pnas.0810114105).

60. T. Powles et al., MPDL3280A (anti-PD-L1) treatment leads to clinical activity in metastatic bladder cancer. Nature 515, 558-562 (2014).

61. S. M. Ansell et al., PD-1 blockade with nivolumab in relapsed or refractory Hodgkin's lymphoma. N Engl J Med 372, 311-319 (2015).

62. A. Snyder et al., Genetic basis for clinical response to CTLA-4 blockade in melanoma. N Engl J Med 371, 2189-2199 (2014).

63. M. S. Rooney, S. A. Shukla, C. J. Wu, G. Getz, N. Hacohen, Molecular and genetic properties of tumors associated with local immune cytolytic activity. Cell 160, 48-61 (2015).

64. R. S. Herbst et al., Predictive correlates of response to the anti-PD-L1 antibody MPDL3280A in cancer patients. Nature 515, 563-567 (2014).

65. P. C. Tumeh et al., PD-1 blockade induces responses by inhibiting adaptive immune resistance. Nature 515, 568-571 (2014).

66. M. M. Gubin et al., Checkpoint blockade cancer immunotherapy targets tumour-specific mutant antigens. Nature 515, 577-581 (2014).

67. M. Yadav et al., Predicting immunogenic tumour mutations by combining mass spectrometry and exome sequencing. Nature 515, 572-576 (2014).

68. F. Duan et al., Genomic and bioinformatic profiling of mutational neoepitopes reveals new rules to predict anticancer immunogenicity. J Exp Med 211, 2231-2248 (2014).

69. C. Linnemann et al., High-throughput epitope discovery reveals frequent recognition of neoantigens by CD4+ T cells in human melanoma. Nat Med 21, 81-85 (2015).

SEQUENCE LISTING (11162 sequences)

SEQ ID NO: 1 - protein, 9 aa, Homo sapiens
QGAARRQQL

SEQ ID NO: 2 - protein, 9 aa, Homo sapiens
MLDDFKRFK

SEQ ID NO: 3 - protein, 9 aa, Homo sapiens
ALQRMSVVL

SEQ ID NO: 4 - protein, 9 aa, Homo sapiens
QRMSVVLAW

SEQ ID NO: 5 - protein, 9 aa, Homo sapiens
QVFRNHLSR

SEQ ID NO: 6 - protein, 9 aa, Homo sapiens
HLSRYCLEH

SEQ ID NO: 7 - protein, 9 aa, Homo sapiens
VFRNHLSRY

SEQ ID NO: 8 - protein, 9 aa, Homo sapiens
LTGEFTVEL

SEQ ID NO: 9 - protein, 9 aa, Homo sapiens
QVFSACKPL

SEQ ID NO: 10 - protein, 9 aa, Homo sapiens
GAAAATGSK

SEQ ID NO: 11 - protein, 9 aa, Homo sapiens
IVRLRPHFL

SEQ ID NO: 12 - protein, 9 aa, Homo sapiens
SSNVPHGSV

SEQ ID NO: 13 - protein, 9 aa, Homo sapiens
KLGDFVATL

SEQ ID NO: 14 - protein, 9 aa, Homo sapiens
ATLHRRLGW

SEQ ID NO: 15 - protein, 9 aa, Homo sapiens
ALWFRKLCF

SEQ ID NO: 16 - protein, 9 aa, Homo sapiens
TLFTYAWPR

SEQ ID NO: 17 - protein, 9 aa, Homo sapiens
SSTLFTYAW

SEQ ID NO: 18 - protein, 9 aa, Homo sapiens
FTYAWPRAM

SEQ ID NO: 19 - protein, 9 aa, Homo sapiens
FTYAWPRAM

SEQ ID NO: 20 - protein, 9 aa, Homo sapiens
YAWPRAMYT

SEQ ID NO: 21 - protein, 9 aa, Homo sapiens
NSREHDQLI

SEQ ID NO: 22 - protein, 9 aa, Homo sapiens
GLRSGNLRY

SEQ ID NO: 23 - protein, 9 aa, Homo sapiens
RSGNLRYRF

SEQ ID NO: 24 - protein, 9 aa, Homo sapiens
NLRYRFWLV

SEQ ID NO: 25 - protein, 9 aa, Homo sapiens
HTLTFFINW

SEQ ID NO: 26 - protein, 9 aa, Homo sapiens
GAHKRPSSV

SEQ ID NO: 27 - protein, 9 aa, Homo sapiens
GAHKRPSSV

SEQ ID NO: 28 - protein, 9 aa, Homo sapiens
SSVSSSAAV

SEQ ID NO: 29 - protein, 9 aa, Homo sapiens
RALMKILGK

SEQ ID NO: 30 - protein, 9 aa, Homo sapiens
EVTRALMKI

SEQ ID NO: 31 - protein, 9 aa, Homo sapiens
LTVHMTQPK

SEQ ID NO: 32 - protein, 9 aa, Homo sapiens
VSAFSTLEK

SEQ ID NO: 33 - protein, 9 aa, Homo sapiens
STLEKELHK

SEQ ID NO: 34 - protein, 9 aa, Homo sapiens
NVHEIVFVV

SEQ ID NO: 35 - protein, 9 aa, Homo sapiens
ALKRTFTNR

SEQ ID NO: 36 - protein, 9 aa, Homo sapiens
RTFTNRFKI

SEQ ID NO: 37 - protein, 9 aa, Homo sapiens
FTNRFKIPI

SEQ ID NO: 38 - protein, 9 aa, Homo sapiens
RTFTNRFKI

SEQ ID NO: 39 - protein, 9 aa, Homo sapiens
FTNRFKIPI

SEQ ID NO: 40 - protein, 9 aa, Homo sapiens
ISIQLDSNM

SEQ ID NO: 41 - protein, 9 aa, Homo sapiens
CSVFPSTIV

SEQ ID NO: 42 - protein, 9 aa, Homo sapiens
KVFGLLEAF

SEQ ID NO: 43 - protein, 9 aa, Homo sapiens
QVDEHSKPL

SEQ ID NO: 44 - protein, 9 aa, Homo sapiens
RVSLWPVAF

SEQ ID NO: 45 - protein, 9 aa, Homo sapiens
MRSTRRVSL

SEQ ID NO: 46 - protein, 9 aa, Homo sapiens
VSLWPVAFV

SEQ ID NO: 47 - protein, 9 aa, Homo sapiens
VMVKSPVEK

SEQ ID NO: 48 - protein, 9 aa, Homo sapiens
MVKSPVEKK

SEQ ID NO: 49 - protein, 9 aa, Homo sapiens
VLSFSYIAK

SEQ ID NO: 50 - protein, 9 aa, Homo sapiens
KMFLAVLSF

SEQ ID NO: 51 - protein, 9 aa, Homo sapiens
LAVLSFSYI

SEQ ID NO: 52 - protein, 9 aa, Homo sapiens
ATGFQSMVI

SEQ ID NO: 53 - protein, 9 aa, Homo sapiens
LATGFQSMV

SEQ ID NO: 54 - protein, 9 aa, Homo sapiens
ATGFQSMVI

SEQ ID NO: 55 - protein, 9 aa, Homo sapiens
VVGASGVGK

SEQ ID NO: 56 - protein, 9 aa, Homo sapiens
LSGEVVSPV

SEQ ID NO: 57 - protein, 9 aa, Homo sapiens
VVSPVNISV

SEQ ID NO: 58 - protein, 9 aa, Homo sapiens
AIIYTVVLK

SEQ ID NO: 59 - protein, 9 aa, Homo sapiens
IIYTVVLKR

SEQ ID NO: 60 - protein, 9 aa, Homo sapiens
VLKRYGGPL

SEQ ID NO: 61 - protein, 9 aa, Homo sapiens
DLEMKYAVL

SEQ ID NO: 62 - protein, 9 aa, Homo sapiens
SKHSDVIAL

SEQ ID NO: 63 - protein, 9 aa, Homo sapiens
CYYCHVYPY

SEQ ID NO: 64 - protein, 9 aa, Homo sapiens
LMITVACLK

SEQ ID NO: 65 - protein, 9 aa, Homo sapiens
CLKLLRSSF

SEQ ID NO: 66 - protein, 9 aa, Homo sapiens
RTPTDLQVL

SEQ ID NO: 67 - protein, 9 aa, Homo sapiens
QPRGNFSCI

SEQ ID NO: 68 - protein, 9 aa, Homo sapiens
RLLILHWHW

SEQ ID NO: 69 - protein, 9 aa, Homo sapiens
HWHWCYSRL

SEQ ID NO: 70 - protein, 9 aa, Homo sapiens
ATSGLLLMI

SEQ ID NO: 71 - protein, 9 aa, Homo sapiens
ATSGLLLMI

SEQ ID NO: 72 - protein, 9 aa, Homo sapiens
IVRQRQQDL

SEQ ID NO: 73 - protein, 9 aa, Homo sapiens
SSIFRTNSF

SEQ ID NO: 74 - protein, 9 aa, Homo sapiens
SSIFRTNSF

SEQ ID NO: 75 - protein, 9 aa, Homo sapiens
GRQPQPVNL

SEQ ID NO: 76 - protein, 9 aa, Homo sapiens
RDMKGALEM

SEQ ID NO: 77 - protein, 9 aa, Homo sapiens
TALQEEQEL

SEQ ID NO: 78 - protein, 9 aa, Homo sapiens
ALGKLLPRK

SEQ ID NO: 79 - protein, 9 aa, Homo sapiens
KTLCTELVL

SEQ ID NO: 80 - protein, 9 aa, Homo sapiens
KTLCTELVL

SEQ ID NO: 81 - protein, 9 aa, Homo sapiens
LPRARRLAK

SEQ ID NO: 82 - protein, 9 aa, Homo sapiens
VELPRARRL

SEQ ID NO: 83 - protein, 9 aa, Homo sapiens
DLKSYLRFL

SEQ ID NO: 84 - protein, 9 aa, Homo sapiens
HLRTHTVYK

SEQ ID NO: 85 - protein, 9 aa, Homo sapiens
RTHTVYKPY

SEQ ID NO: 86 - protein, 9 aa, Homo sapiens
TRQPPAPNL

SEQ ID NO: 87 - protein, 9 aa, Homo sapiens
IPYFTTSDI

SEQ ID NO: 88 - protein, 9 aa, Homo sapiens
GLSHMQYLF

SEQ ID NO: 89 - protein, 9 aa, Homo sapiens
LSHMQYLFI

SEQ ID NO: 90 - protein, 9 aa, Homo sapiens
KILQLTLNF

SEQ ID NO: 91 - protein, 9 aa, Homo sapiens
STINKILQL

SEQ ID NO: 92 - protein, 9 aa, Homo sapiens
TPLISAGVI

SEQ ID NO: 93 - protein, 9 aa, Homo sapiens
RTPLISAGV

SEQ ID NO: 94 - protein, 9 aa, Homo sapiens
DTYPRCPAK

SEQ ID NO: 95 - protein, 9 aa, Homo sapiens
KSDIGTQTV

SEQ ID NO: 96 - protein, 9 aa, Homo sapiens
SREPVVALY

SEQ ID NO: 97 - protein, 9 aa, Homo sapiens
LLRGLLAPL

SEQ ID NO: 98 - protein, 9 aa, Homo sapiens
MPRSRGTRL

SEQ ID NO: 99 - protein, 9 aa, Homo sapiens
SRGTRLKPA

SEQ ID NO: 100 - protein, 9 aa, Homo sapiens
ELNPRGHNV

SEQ ID NO: 101 - protein, 9 aa, Homo sapiens
STDGHSSYV

SEQ ID NO: 102 - protein, 9 aa, Homo sapiens
RSAIFLGPK

SEQ ID NO: 103 - protein, 9 aa, Homo sapiens
IFLGPKGSL

SEQ ID NO: 104 - protein, 9 aa, Homo sapiens
SVVIPYLRK

SEQ ID NO: 105 - protein, 9 aa, Homo sapiens
TQRPRTAQL

SEQ ID NO: 106 - protein, 9 aa, Homo sapiens
WLGTSIASL

SEQ ID NO: 107 - protein, 9 aa, Homo sapiens
AVSSLALEI

SEQ ID NO: 108 - protein, 9 aa, Homo sapiens
SSISSFKQK

SEQ ID NO: 109 - protein, 9 aa, Homo sapiens
SSFKQKISF

SEQ ID NO: 110 - protein, 9 aa, Homo sapiens
SFKQKISFA

SEQ ID NO: 111 - protein, 9 aa, Homo sapiens
EILGKGNPV

SEQ ID NO: 112 - protein, 9 aa, Homo sapiens
ELQRRLERL

SEQ ID NO: 113 - protein, 9 aa, Homo sapiens
RRLERLYPA

SEQ ID NO: 114 - protein, 9 aa, Homo sapiens
VRFLLRDIY

SEQ ID NO: 115 - protein, 9 aa, Homo sapiens
SLGQRELEF

SEQ ID NO: 116 - protein, 9 aa, Homo sapiens
ATEFFLQQV

SEQ ID NO: 117 - protein, 9 aa, Homo sapiens
SELQRSAQL

SEQ ID NO: 118 - protein, 9 aa, Homo sapiens
TVEHSFVHK

SEQ ID NO: 119 - protein, 9 aa, Homo sapiens
HSFVHKVRK

SEQ ID NO: 120 - protein, 9 aa, Homo sapiens
KVRKITLEV

SEQ ID NO: 121 - protein, 9 aa, Homo sapiens
YVQTTSTEI

SEQ ID NO: 122 - protein, 9 aa, Homo sapiens
KCNRTVHYV

SEQ ID NO: 123 - protein, 9 aa, Homo sapiens
SSNEVTIML

SEQ ID NO: 124 - protein, 9 aa, Homo sapiens
VTIMLSSIV

SEQ ID NO: 125 - protein, 9 aa, Homo sapiens
HLRKRLKSH

SEQ ID NO: 126 - protein, 9 aa, Homo sapiens
RKRLKSHPA

SEQ ID NO: 127 - protein, 9 aa, Homo sapiens
PLLSCQYLK

SEQ ID NO: 128 - protein, 9 aa, Homo sapiens
MPLLSCQYL

SEQ ID NO: 129 - protein, 9 aa, Homo sapiens
MPLLSCQYL

SEQ ID NO: 130 - protein, 9 aa, Homo sapiens
CRWPPLGLY

SEQ ID NO: 131 - protein, 9 aa, Homo sapiens
STYEEEEAF

SEQ ID NO: 132 - protein, 9 aa, Homo sapiens
STYEEEEAF

SEQ ID NO: 133 - protein, 9 aa, Homo sapiens
LTADELHFL

SEQ ID NO: 134 - protein, 9 aa, Homo sapiens
LVGDFASVV

SEQ ID NO: 135 - protein, 9 aa, Homo sapiens
SSYQVLVLL

SEQ ID NO: 136 - protein, 9 aa, Homo sapiens
LLLALQSTF

SEQ ID NO: 137 - protein, 9 aa, Homo sapiens
SYQVLVLLL

SEQ ID NO: 138 - protein, 9 aa, Homo sapiens
SSYQVLVLL

SEQ ID NO: 139 - protein, 9 aa, Homo sapiens
TSTEATHEI

SEQ ID NO: 140 - protein, 9 aa, Homo sapiens
RSSDLRLPK

SEQ ID NO: 141 - protein, 9 aa, Homo sapiens
FRRSSDLRL

SEQ ID NO: 142 - protein, 9 aa, Homo sapiens
VAMTVAMSV

SEQ ID NO: 143 - protein, 9 aa, Homo sapiens
LLRALRRNL

SEQ ID NO: 144 - protein, 9 aa, Homo sapiens
ERRAHCTEL

SEQ ID NO: 145 - protein, 9 aa, Homo sapiens
PARDMEQYV

SEQ ID NO: 146 - protein, 9 aa, Homo sapiens
SVHALYLEW

SEQ ID NO: 147 - protein, 9 aa, Homo sapiens
LYLEWRSGL

SEQ ID NO: 148 - protein, 9 aa, Homo sapiens
RPSVHALYL

SEQ ID NO: 149 - protein, 9 aa, Homo sapiens
VLKEKSMIV

SEQ ID NO: 150 - protein, 9 aa, Homo sapiens
KSMIVKQKL

SEQ ID NO: 151 - protein, 9 aa, Homo sapiens
WREGRDQLV

SEQ ID NO: 152 - protein, 9 aa, Homo sapiens
VVLDKGRIV

SEQ ID NO: 153 - protein, 9 aa, Homo sapiens
FQIKVNLMI

SEQ ID NO: 154 - protein, 9 aa, Homo sapiens
LLLEKVEFL

SEQ ID NO: 155 - protein, 9 aa, Homo sapiens
QRDKARLLL

SEQ ID NO: 156 - protein, 9 aa, Homo sapiens
KARLLLEKV

SEQ ID NO: 157 - protein, 9 aa, Homo sapiens
WMGNALSPL

SEQ ID NO: 158 - protein, 9 aa, Homo sapiens
LPIYLPEKV

SEQ ID NO: 159 - protein, 9 aa, Homo sapiens
FRVLRNEAL

SEQ ID NO: 160 - protein, 9 aa, Homo sapiens
EALTRPNCM

SEQ ID NO: 161 - protein, 9 aa, Homo sapiens
FRVLRNGTL

SEQ ID NO: 162 - protein, 9 aa, Homo sapiens
GTLTRPNCM

SEQ ID NO: 163 - protein, 9 aa, Homo sapiens
FCHETSPEM

SEQ ID NO: 164 - protein, 9 aa, Homo sapiens
QQQERSHLL

SEQ ID NO: 165 - protein, 9 aa, Homo sapiens
QQQERSHLL

SEQ ID NO: 166 - protein, 9 aa, Homo sapiens
KLKNATVLI

SEQ ID NO: 167 - protein, 9 aa, Homo sapiens
QLILLFQRV

SEQ ID NO: 168 - protein, 9 aa, Homo sapiens
LLFQRVGRL

SEQ ID NO: 169 - protein, 9 aa, Homo sapiens
DVYEHQLIL

SEQ ID NO: 170 - protein, 9 aa, Homo sapiens
AQWHMEYVI

SEQ ID NO: 171 - protein, 9 aa, Homo sapiens
YVIEDIIGM

SEQ ID NO: 172 - protein, 9 aa, Homo sapiens
NAQWHMEYV

SEQ ID NO: 173 - protein, 9 aa, Homo sapiens
FRRPSREHY

SEQ ID NO: 174 - protein, 9 aa, Homo sapiens
RRPSREHYY

SEQ ID NO: 175 - protein, 9 aa, Homo sapiens
MAEEPSDLI

SEQ ID NO: 176 - protein, 9 aa, Homo sapiens
TTDGSLLLL

SEQ ID NO: 177 - protein, 9 aa, Homo sapiens
SSTGHSSSY

SEQ ID NO: 178 - protein, 9 aa, Homo sapiens
SSTGHSSSY

SEQ ID NO: 179 - protein, 9 aa, Homo sapiens
STFCHPFPL

SEQ ID NO: 180 - protein, 9 aa, Homo sapiens
TTSTFCHPF

SEQ ID NO: 181 - protein, 9 aa, Homo sapiens
LTTPAFPAM

SEQ ID NO: 182 - protein, 9 aa, Homo sapiens
SVLPLSGHV

SEQ ID NO: 183 - protein, 9 aa, Homo sapiens
VPAPSVLPL

SEQ ID NO: 184 - protein, 9 aa, Homo sapiens
LPFYWCAFF

SEQ ID NO: 185 - protein, 9 aa, Homo sapiens
LLIFRLVST

SEQ ID NO: 186 - protein, 9 aa, Homo sapiens
LPSPLRVPS

SEQ ID NO: 187 - protein, 9 aa, Homo sapiens
ILLDWAANI

SEQ ID NO: 188 - protein, 9 aa, Homo sapiens
LLDWAANIY

SEQ ID NO: 189 - protein, 9 aa, Homo sapiens
LLDWAANIY

SEQ ID NO: 190 - protein, 9 aa, Homo sapiens
KLSELHTYI

SEQ ID NO: 191 - protein, 9 aa, Homo sapiens
ELHTYILRV

SEQ ID NO: 192 - protein, 9 aa, Homo sapiens
VPASASHPR

SEQ ID NO: 193 - protein, 9 aa, Homo sapiens
HLTSKMVGY

SEQ ID NO: 194 - protein, 9 aa, Homo sapiens
EPWGRFGAA

SEQ ID NO: 195 - protein, 9 aa, Homo sapiens
ITLNNLAFI

SEQ ID NO: 196 - protein, 9 aa, Homo sapiens
DITLNNLAF

SEQ ID NO: 197 - protein, 9 aa, Homo sapiens
AEQLSVPQG

SEQ ID NO: 198 - protein, 9 aa, Homo sapiens
LSVPQGILF

SEQ ID NO: 199 - protein, 9 aa, Homo sapiens
VVPCEPPEV

SEQ ID NO: 200 - protein, 9 aa, Homo sapiens
LLFSNRLEA

SEQ ID NO: 201 - protein, 9 aa, Homo sapiens
MAEPQPLAL

SEQ ID NO: 202 - protein, 9 aa, Homo sapiens
MAEPQPLAL

SEQ ID NO: 203 - protein, 9 aa, Homo sapiens
ILGSRTAGL

SEQ ID NO: 204 - protein, 9 aa, Homo sapiens
MERRIKAGY

SEQ ID NO: 205 - protein, 9 aa, Homo sapiens
LLFALHFSA

SEQ ID NO: 206 - protein, 9 aa, Homo sapiens
LLLNCCACA

SEQ ID NO: 207 - protein, 9 aa, Homo sapiens
LLNCCACAA

SEQ ID NO: 208 - protein, 9 aa, Homo sapiens
PEPCLQRQY

SEQ ID NO: 209 - protein, 9 aa, Homo sapiens
SLPPVAAAA

SEQ ID NO: 210 - protein, 9 aa, Homo sapiens
NPMNSLPPV

SEQ ID NO: 211 - protein, 9 aa, Homo sapiens
LPPVAAAAA

SEQ ID NO: 212 - protein, 9 aa, Homo sapiens
PPVAAAAAA

SEQ ID NO: 213 - protein, 9 aa, Homo sapiens
VAAAAAASF

SEQ ID NO: 214 - protein, 9 aa, Homo sapiens
WLAGSPMSF

SEQ ID NO: 215 - protein, 9 aa, Homo sapiens
MSFQALLTL

SEQ ID NO: 216 - protein, 9 aa, Homo sapiens
ITKNHNGLY

SEQ ID NO: 217 - protein, 9 aa, Homo sapiens
YALLGSHLV

SEQ ID NO: 218 - protein, 9 aa, Homo sapiens
ALLGSHLVL

SEQ ID NO: 219 - protein, 9 aa, Homo sapiens
ELAYHYALL

SEQ ID NO: 220 - protein, 9 aa, Homo sapiens
EELAYHYAL

SEQ ID NO: 221 - protein, 9 aa, Homo sapiens
FPSIRDLAQ

SEQ ID NO: 222 - protein, 9 aa, Homo sapiens
ALDGEAVVL

SEQ ID NO: 223 - protein, 9 aa, Homo sapiens
ALDGEAVVL

SEQ ID NO: 224 - protein, 9 aa, Homo sapiens
FLPDLNVNA

SEQ ID NO: 225 - protein, 9 aa, Homo sapiens
LPDLNVNAA

SEQ ID NO: 226 - protein, 9 aa, Homo sapiens
LPIDTQNYL

SEQ ID NO: 227 - protein, 9 aa, Homo sapiens
SPFDLEAHF

SEQ ID NO: 228 - protein, 9 aa, Homo sapiens
KAFSHISYL

SEQ ID NO: 229 - protein, 9 aa, Homo sapiens
PLGIWLPHV

SEQ ID NO: 230 - protein, 9 aa, Homo sapiens
WLPHVEYEL

SEQ ID NO: 231 - protein, 9 aa, Homo sapiens
LPLGIWLPH

SEQ ID NO: 232 - protein, 9 aa, Homo sapiens
GLVTGTAAL

SEQ ID NO: 233 - protein, 9 aa, Homo sapiens
YADHMGLTC

SEQ ID NO: 234 - protein, 9 aa, Homo sapiens
EILGETSLM

SEQ ID NO: 235 - protein, 9 aa, Homo sapiens
ITDFGHSEI

SEQ ID NO: 236 - protein, 9 aa, Homo sapiens
WLLSPACPA

SEQ ID NO: 237 - protein, 9 aa, Homo sapiens
RQLGITIVL

SEQ ID NO: 238 - protein, 9 aa, Homo sapiens
SSSDHLAFV

SEQ ID NO: 239 - protein, 9 aa, Homo sapiens
DSSSDHLAF

SEQ ID NO: 240 - protein, 9 aa, Homo sapiens
LPSRSLQVL

SEQ ID NO: 241 - protein, 9 aa, Homo sapiens
LPVIGLSSA

SEQ ID NO: 242 - protein, 9 aa, Homo sapiens
HPSGTCPAA

SEQ ID NO: 243 - protein, 9 aa, Homo sapiens
DAIGVVPPV

SEQ ID NO: 244 - protein, 9 aa, Homo sapiens
EVDDAIGVV

SEQ ID NO: 245 - protein, 9 aa, Homo sapiens
FIFAFKGRY

SEQ ID NO: 246 - protein, 9 aa, Homo sapiens
FIFAFKGRY

SEQ ID NO: 247 - protein, 9 aa, Homo sapiens
VLFHRAFLV

SEQ ID NO: 248 - protein, 9 aa, Homo sapiens
AAVLFHRAF

SEQ ID NO: 249 - protein, 9 aa, Homo sapiens
SSSTENFCY

SEQ ID NO: 250 - protein, 9 aa, Homo sapiens
STENFCYVF

SEQ ID NO: 251 - protein, 9 aa, Homo sapiens
RLLPSIGLL

SEQ ID NO: 252 - protein, 9 aa, Homo sapiens
LPSIGLLTV

SEQ ID NO: 253 - protein, 9 aa, Homo sapiens
MGGAMVPPM

SEQ ID NO: 254 - protein, 9 aa, Homo sapiens
CPFGGALAL

SEQ ID NO: 255 - protein, 9 aa, Homo sapiens
SLVPPAEEI

SEQ ID NO: 256 - protein, 9 aa, Homo sapiens
LVPPAEEIY

SEQ ID NO: 257 - protein, 9 aa, Homo sapiens
PPAEEIYQY

SEQ ID NO: 258 - protein, 9 aa, Homo sapiens
PADPKPGVI

SEQ ID NO: 259 - protein, 9 aa, Homo sapiens
GLSEVCAAL

SEQ ID NO: 260 - protein, 9 aa, Homo sapiens
CAALGLALY

SEQ ID NO: 261 - protein, 9 aa, Homo sapiens
SEVCAALGL

SEQ ID NO: 262 - protein, 9 aa, Homo sapiens
TLALATAAA

SEQ ID NO: 263 - protein, 9 aa, Homo sapiens
ALATAAATA

SEQ ID NO: 264 - protein, 9 aa, Homo sapiens
VPITLALAT

SEQ ID NO: 265 - protein, 9 aa, Homo sapiens
LALATAAAT

SEQ ID NO: 266 - protein, 9 aa, Homo sapiens
LATAAATAS

SEQ ID NO: 267 - protein, 9 aa, Homo sapiens
TAAATASSL

SEQ ID NO: 268 - protein, 9 aa, Homo sapiens
FSQQRLSLY

SEQ ID NO: 269 - protein, 9 aa, Homo sapiens
AEWFSQQRL

SEQ ID NO: 270 - protein, 9 aa, Homo sapiens
NPLSACSVM

SEQ ID NO: 271 - protein, 9 aa, Homo sapiens
IPNIKQNHY

SEQ ID NO: 272 - protein, 9 aa, Homo sapiens
DVAKFTSSL

SEQ ID NO: 273 - protein, 9 aa, Homo sapiens
TSCQPSVAY

SEQ ID NO: 274 - protein, 9 aa, Homo sapiens
KVLMQLESL

SEQ ID NO: 275 - protein, 9 aa, Homo sapiens
FMSSYSGVL

SEQ ID NO: 276 - protein, 9 aa, Homo sapiens
SLCTFMSSY

SEQ ID NO: 277 - protein, 9 aa, Homo sapiens
FMSSYSGVL

SEQ ID NO: 278 - protein, 9 aa, Homo sapiens
VTGRLASGK

SEQ ID NO: 279 - protein, 9 aa, Homo sapiens
TSDILKIPK

SEQ ID NO: 280 - protein, 9 aa, Homo sapiens
SVDPATFPI

SEQ ID NO: 281 - protein, 9 aa, Homo sapiens
FEIFFGRQM

SEQ ID NO: 282 - protein, 9 aa, Homo sapiens
SSVFRLTVR

SEQ ID NO: 283 - protein, 9 aa, Homo sapiens
KHLQVNITL

SEQ ID NO: 284 - protein, 9 aa, Homo sapiens
LHANQDEQV

SEQ ID NO: 285 - protein, 9 aa, Homo sapiens
SLACMDTSA

SEQ ID NO: 286 - protein, 9 aa, Homo sapiens
YTWFMLARI

SEQ ID NO: 287 - protein, 9 aa, Homo sapiens
SSYTWFMLA

SEQ ID NO: 288 - protein, 9 aa, Homo sapiens
SYTWFMLAR

SEQ ID NO: 289 - protein, 9 aa, Homo sapiens
TKSSYTWFM

SEQ ID NO: 290 - protein, 9 aa, Homo sapiens
RTLGQAFEV

SEQ ID NO: 291 - protein, 9 aa, Homo sapiens
STWDSWNER

SEQ ID NO: 292 - protein, 9 aa, Homo sapiens
LLGDDDSYL

SEQ ID NO: 293 - protein, 9 aa, Homo sapiens
IQSFYRMNR

SEQ ID NO: 294 - protein, 9 aa, Homo sapiens
SFYRMNRAK

SEQ ID NO: 295 - protein, 9 aa, Homo sapiens
LESPALPMI

SEQ ID NO: 296 - protein, 9 aa, Homo sapiens
LILPQDHPV

SEQ ID NO: 297 - protein, 9 aa, Homo sapiens
NEAPLILPQ

SEQ ID NO: 298 - protein, 9 aa, Homo sapiens
FHTANQSLQ

SEQ ID NO: 299 - protein, 9 aa, Homo sapiens
KMPLANIYL

SEQ ID NO: 300 - protein, 9 aa, Homo sapiens
FNMSYKYPI

SEQ ID NO: 301 - protein, 9 aa, Homo sapiens
STLSFNMSY

SEQ ID NO: 302 - protein, 9 aa, Homo sapiens
TLSFNMSYK

SEQ ID NO: 303 - protein, 9 aa, Homo sapiens
LSFNMSYKY

SEQ ID NO: 304 - protein, 9 aa, Homo sapiens
KQNRLRAQK

SEQ ID NO: 305 - protein, 9 aa, Homo sapiens
GLQSFQMLV

SEQ ID NO: 306 - protein, 9 aa, Homo sapiens
QSFQMLVSK

SEQ ID NO: 307 - protein, 9 aa, Homo sapiens
CASPHPQCL

SEQ ID NO: 308 - protein, 9 aa, Homo sapiens
SNHDLIQRL

SEQ ID NO: 309 - protein, 9 aa, Homo sapiens
LVIGMPPPV

SEQ ID NO: 310 - protein, 9 aa, Homo sapiens
GHPVRLECL

SEQ ID NO: 311 - protein, 9 aa, Homo sapiens
ASLETGFAK

SEQ ID NO: 312 - protein, 9 aa, Homo sapiens
SLETGFAKK

SEQ ID NO: 313 - protein, 9 aa, Homo sapiens
SHLDFGDYI

SEQ ID NO: 314 - protein, 9 aa, Homo sapiens
RLKDAFDYI

SEQ ID NO: 315 - protein, 9 aa, Homo sapiens
KSDSTTAPK

SEQ ID NO: 316 - protein, 9 aa, Homo sapiens
LEAAGLLTY

SEQ ID NO: 317 - protein, 9 aa, Homo sapiens
ILIVMFPFL

SEQ ID NO: 318 - protein, 9 aa, Homo sapiens
LIVMFPFLL

SEQ ID NO: 319 - protein, 9 aa, Homo sapiens
IVMFPFLLI

SEQ ID NO: 320 - protein, 9 aa, Homo sapiens
VMFPFLLIL

SEQ ID NO: 321 - protein, 9 aa, Homo sapiens
HLNQYNSYK

SEQ ID NO: 322 - protein, 9 aa, Homo sapiens
IEHEHLNQY

SEQ ID NO: 323 - protein, 9 aa, Homo sapiens
AIFKPLHYL

SEQ ID NO: 324 - protein, 9 aa, Homo sapiens
ILIFSCCNL

SEQ ID NO: 325 - protein, 9 aa, Homo sapiens
LIFSCCNLL

SEQ ID NO: 326 - protein, 9 aa, Homo sapiens
FLFTFFAFI

SEQ ID NO: 327 - protein, 9 aa, Homo sapiens
FAFIDCYLL

SEQ ID NO: 328 - protein, 9 aa, Homo sapiens
FIDCYLLAI

SEQ ID NO: 329 - protein, 9 aa, Homo sapiens
FFLFTFFAF

SEQ ID NO: 330 - protein, 9 aa, Homo sapiens
TRSEHGRYL

SEQ ID NO: 331 - protein, 9 aa, Homo sapiens
RLQEAVEAA

SEQ ID NO: 332 - protein, 9 aa, Homo sapiens
YLNELVVFV

SEQ ID NO: 333 - protein, 9 aa, Homo sapiens
QHAIQVLHI

SEQ ID NO: 334 - protein, 9 aa, Homo sapiens
SSPLSHGSK

SEQ ID NO: 335 - protein, 9 aa, Homo sapiens
RRFRDVNHY

SEQ ID NO: 336 - protein, 9 aa, Homo sapiens
VVGACGVGK

SEQ ID NO: 337 - protein, 9 aa, Homo sapiens
ASTIRTCQK

SEQ ID NO: 338 - protein, 9 aa, Homo sapiens
YVPTISHPI

SEQ ID NO: 339 - protein, 9 aa, Homo sapiens
ALSKLVIRR

SEQ ID NO: 340 - protein, 9 aa, Homo sapiens
KRTALSKLV

SEQ ID NO: 341 - protein, 9 aa, Homo sapiens
YESSDRITF

SEQ ID NO: 342 - protein, 9 aa, Homo sapiens
RHHESEPSL

SEQ ID NO: 343 - protein, 9 aa, Homo sapiens
QVYISNYNK

SEQ ID NO: 344 - protein, 9 aa, Homo sapiens
ASNASSAAK

SEQ ID NO: 345 - protein, 9 aa, Homo sapiens
HLSPMAAEA

SEQ ID NO: 346 - protein, 9 aa, Homo sapiens
TSSTFPGSR

SEQ ID NO: 347 - protein, 9 aa, Homo sapiens
KEVKTSSTF

SEQ ID NO: 348 - protein, 9 aa, Homo sapiens
CEHGDGYPF

SEQ ID NO: 349 - protein, 9 aa, Homo sapiens
KLFSGCTLT

SEQ ID NO: 350 - protein, 9 aa, Homo sapiens
FEGFLAKLF

SEQ ID NO: 351 - protein, 9 aa, Homo sapiens
SISENQSLL

SEQ ID NO: 352 - protein, 9 aa, Homo sapiens
RLHDLVFPL

SEQ ID NO: 353 - protein, 9 aa, Homo sapiens
LVFPLVMGV

SEQ ID NO: 354 - protein, 9 aa, Homo sapiens
ILITQVLGL

SEQ ID NO: 355 - protein, 9 aa, Homo sapiens
RRCPHRERC

SEQ ID NO: 356 - protein, 9 aa, Homo sapiens
GVLVDSSHK

SEQ ID NO: 357 - protein, 9 aa, Homo sapiens
YQSSSSTSV

SEQ ID NO: 358 - protein, 9 aa, Homo sapiens
SVLSNGFYH

SEQ ID NO: 359 - protein, 9 aa, Homo sapiens
TLTEKLVAI

SEQ ID NO: 360 - protein, 9 aa, Homo sapiens
AITMGSGAK

SEQ ID NO: 361 - protein, 9 aa, Homo sapiens
TEKLVAITM

SEQ ID NO: 362 - protein, 9 aa, Homo sapiens
YLSNSSFAK

SEQ ID NO: 363 - protein, 9 aa, Homo sapiens
KTEELNHEV

SEQ ID NO: 364 - protein, 9 aa, Homo sapiens
FCDSACFTL

SEQ ID NO: 365 - protein, 9 aa, Homo sapiens
TEFCDSACF

SEQ ID NO: 366 - protein, 9 aa, Homo sapiens
GQAHLTTSK

SEQ ID NO: 367 - protein, 9 aa, Homo sapiens
QLDGSSSSV

SEQ ID NO: 368 - protein, 9 aa, Homo sapiens
MVVWLSWKI

SEQ ID NO: 369 - protein, 9 aa, Homo sapiens
LMVVWLSWK

SEQ ID NO: 370 - protein, 9 aa, Homo sapiens
VVWLSWKIK

SEQ ID NO: 371 - protein, 9 aa, Homo sapiens
ALAILEFAV

SEQ ID NO: 372 - protein, 9 aa, Homo sapiens
ILEFAVKPV

SEQ ID NO: 373 - protein, 9 aa, Homo sapiens
LAILEFAVK

SEQ ID NO: 374 - protein, 9 aa, Homo sapiens
LEFAVKPVV

SEQ ID NO: 375 - protein, 9 aa, Homo sapiens
TMRWKLLPL

SEQ ID NO: 376 - protein, 9 aa, Homo sapiens
EHEEEVTMV

SEQ ID NO: 377 - protein, 9 aa, Homo sapiens
FIHPEYSAV

SEQ ID NO: 378 - protein, 9 aa, Homo sapiens
KQFFYNFIH

SEQ ID NO: 379 - protein, 9 aa, Homo sapiens
RVDAVFTHR

SEQ ID NO: 380 - protein, 9 aa, Homo sapiens
SLFYGTAFA

SEQ ID NO: 381 - protein, 9 aa, Homo sapiens
FAVYISSAV

SEQ ID NO: 382 - protein, 9 aa, Homo sapiens
TTHKKIHTV

SEQ ID NO: 383 - protein, 9 aa, Homo sapiens
IHTVEQPYI

SEQ ID NO: 384 - protein, 9 aa, Homo sapiens
LLLYYLAQT

SEQ ID NO: 385 - protein, 9 aa, Homo sapiens
LVKALLLYY

SEQ ID NO: 386 - protein, 9 aa, Homo sapiens
KTLKVVCAV

SEQ ID NO: 387 - protein, 9 aa, Homo sapiens
SQKGYQHFV

SEQ ID NO: 388 - protein, 9 aa, Homo sapiens
GYQHFVLMK

SEQ ID NO: 389 - protein, 9 aa, Homo sapiens
MDFELEIEF

SEQ ID NO: 390 - protein, 9 aa, Homo sapiens
FELEIEFES

SEQ ID NO: 391 - protein, 9 aa, Homo sapiens
NYMDFELEI

SEQ ID NO: 392 - protein, 9 aa, Homo sapiens
RQLDLCVNL

SEQ ID NO: 393 - protein, 9 aa, Homo sapiens
QLDLCVNLL

SEQ ID NO: 394 - protein, 9 aa, Homo sapiens
LRSFYNPRI

SEQ ID NO: 395 - protein, 9 aa, Homo sapiens
GICNLRGIK

SEQ ID NO: 396 - protein, 9 aa, Homo sapiens
KQPPHQMEV

SEQ ID NO: 397 - protein, 9 aa, Homo sapiens
SRGPPNLHM

SEQ ID NO: 398 - protein, 9 aa, Homo sapiens
IRNKTSGVV

SEQ ID NO: 399 - protein, 9 aa, Homo sapiens
LRLKERHCL

SEQ ID NO: 400 - protein, 9 aa, Homo sapiens
EMIETSFSL

SEQ ID NO: 401 - protein, 9 aa, Homo sapiens
TSFSLNIPK

SEQ ID NO: 402 - protein, 9 aa, Homo sapiens
KVIVVTPKV

SEQ ID NO: 403 - protein, 9 aa, Homo sapiens
SGMFRNGLK

SEQ ID NO: 404 - protein, 9 aa, Homo sapiens
FRNGLKDGY

SEQ ID NO: 405 - protein, 9 aa, Homo sapiens
WVLVVVVGV

SEQ ID NO: 406 - protein, 9 aa, Homo sapiens
TEILLTPTR

SEQ ID NO: 407 - protein, 9 aa, Homo sapiens
VLNHFLCDI

SEQ ID NO: 408 - protein, 9 aa, Homo sapiens
FLCDISPIL

SEQ ID NO: 409 - protein, 9 aa, Homo sapiens
EVNPWNREV

SEQ ID NO: 410 - protein, 9 aa, Homo sapiens
QAIKGSFYR

SEQ ID NO: 411 - protein, 9 aa, Homo sapiens
AIKGSFYRR

SEQ ID NO: 412 - protein, 9 aa, Homo sapiens
GSFYRRAQR

SEQ ID NO: 413 - protein, 9 aa, Homo sapiens
SFYRRAQRL

SEQ ID NO: 414 - protein, 9 aa, Homo sapiens
VELETGPEQ

SEQ ID NO: 415 - protein, 9 aa, Homo sapiens
IRRVWAQEI

SEQ ID NO: 416 - protein, 9 aa, Homo sapiens
AAMSASSER

SEQ ID NO: 417 - protein, 9 aa, Homo sapiens
FMIGTIIAK

SEQ ID NO: 418 - protein, 9 aa, Homo sapiens
GTIIAKMAR

SEQ ID NO: 419 - protein, 9 aa, Homo sapiens
IIAKMARPK

SEQ ID NO: 420 - protein, 9 aa, Homo sapiens
VLAAVQNPA

SEQ ID NO: 421 - protein, 9 aa, Homo sapiens
ELLPLTPVL

SEQ ID NO: 422 - protein, 9 aa, Homo sapiens
ATSVRGLAK

SEQ ID NO: 423 - protein, 9 aa, Homo sapiens
YMGDGELCL

SEQ ID NO: 424 - protein, 9 aa, Homo sapiens
ALGQAITLL

SEQ ID NO: 425 - protein, 9 aa, Homo sapiens
GMSPEVTLA

SEQ ID NO: 426 - protein, 9 aa, Homo sapiens
VIFSAIHFL

SEQ ID NO: 427 - protein, 9 aa, Homo sapiens
SAIHFLASL

SEQ ID NO: 428 - protein, 9 aa, Homo sapiens
FLASLALST

SEQ ID NO: 429 - protein, 9 aa, Homo sapiens
IHFLASLAL

SEQ ID NO: 430 - protein, 9 aa, Homo sapiens
TLVMFYAPL

SEQ ID NO: 431 - protein, 9 aa, Homo sapiens
VVAASAAAK

SEQ ID NO: 432 - protein, 9 aa, Homo sapiens
SAAAKTTSK

SEQ ID NO: 433 - protein, 9 aa, Homo sapiens
ALDANETLL

SEQ ID NO: 434 - protein, 9 aa, Homo sapiens
NETLLLTGS

SEQ ID NO: 435 - protein, 9 aa, Homo sapiens
MALDANETL

SEQ ID NO: 436 - protein, 9 aa, Homo sapiens
HTAHISELK

SEQ ID NO: 437 - protein, 9 aa, Homo sapiens
RHTAHISEL

SEQ ID NO: 438 - protein, 9 aa, Homo sapiens
VQYLGMFPV

SEQ ID NO: 439 - protein, 9 aa, Homo sapiens
GMFPVDKPV

SEQ ID NO: 440 - protein, 9 aa, Homo sapiens
FHVQYLGMF

SEQ ID NO: 441 - protein, 9 aa, Homo sapiens
DEQNCTMEI

SEQ ID NO: 442 - protein, 9 aa, Homo sapiens
IIDFHYNEK

SEQ ID NO: 443 - protein, 9 aa, Homo sapiens
ISFCHYFLL

SEQ ID NO: 444 - protein, 9 aa, Homo sapiens
AVHQISFCH

SEQ ID NO: 445 - protein, 9 aa, Homo sapiens
HYFLLDIAF

SEQ ID NO: 446 - protein, 9 aa, Homo sapiens
NLFIQDISV

SEQ ID NO: 447 - protein, 9 aa, Homo sapiens
FIQDISVKM

SEQ ID NO: 448 - protein, 9 aa, Homo sapiens
DQCSGNGTY

SEQ ID NO: 449 - protein, 9 aa, Homo sapiens
IHLHSSQVL

SEQ ID NO: 450 - protein, 9 aa, Homo sapiens
ISQRVAAEK

SEQ ID NO: 451 - protein, 9 aa, Homo sapiens
FLHEIFHQV

SEQ ID NO: 452 - protein, 9 aa, Homo sapiens
LHEIFHQVL

SEQ ID NO: 453 - protein, 9 aa, Homo sapiens
FHQVLKARI

SEQ ID NO: 454 - protein, 9 aa, Homo sapiens
SRKSEDLSL

SEQ ID NO: 455 - protein, 9 aa, Homo sapiens
GVCGFDLHK

SEQ ID NO: 456 - protein, 9 aa, Homo sapiens
GSNINKSLK

SEQ ID NO: 457 - protein, 9 aa, Homo sapiens
STMAVYIPT

SEQ ID NO: 458 - protein, 9 aa, Homo sapiens
ESFSIYVYK

SEQ ID NO: 459 - protein, 9 aa, Homo sapiens
KESFSIYVY

SEQ ID NO: 460 - protein, 9 aa, Homo sapiens
KQSASAVHV

SEQ ID NO: 461 - protein, 9 aa, Homo sapiens
VHVPVSVAM

SEQ ID NO: 462 - protein, 9 aa, Homo sapiens
MLRIVELYV

SEQ ID NO: 463 - protein, 9 aa, Homo sapiens
KMLRIVELY

SEQ ID NO: 464 - protein, 9 aa, Homo sapiens
VELYVTWGF

SEQ ID NO: 465 - protein, 9 aa, Homo sapiens
ATLGNSYGR

SEQ ID NO: 466 - protein, 9 aa, Homo sapiens
TRKRGPEIL

SEQ ID NO: 467 - protein, 9 aa, Homo sapiens
IAENTEFFK

SEQ ID NO: 468 - protein, 9 aa, Homo sapiens
LHTVCHPNI

SEQ ID NO: 469 - protein, 9 aa, Homo sapiens
FFIPLIFMI

SEQ ID NO: 470 - protein, 9 aa, Homo sapiens
GRIELYRVV

SEQ ID NO: 471 - protein, 9 aa, Homo sapiens
RIFSSSYVA

SEQ ID NO: 472 - protein, 9 aa, Homo sapiens
FSSSYVAFI

SEQ ID NO: 473 - protein, 9 aa, Homo sapiens
SSYVAFISY

SEQ ID NO: 474 - protein, 9 aa, Homo sapiens
SRIFSSSYV

SEQ ID NO: 475 - protein, 9 aa, Homo sapiens
FSSSYVAFI

SEQ ID NO: 476 - protein, 9 aa, Homo sapiens
HIIPFQPQK

SEQ ID NO: 477 - protein, 9 aa, Homo sapiens
LRRTTDRKL

SEQ ID NO: 478 - protein, 9 aa, Homo sapiens
DEISKLIQL

SEQ ID NO: 479 - protein, 9 aa, Homo sapiens
YLDIQVFYR

SEQ ID NO: 480 - protein, 9 aa, Homo sapiens
LELEWAYSE

SEQ ID NO: 481 - protein, 9 aa, Homo sapiens
NHPVCKEHL

SEQ ID NO: 482 - protein, 9 aa, Homo sapiens
TNTDHLFTV

SEQ ID NO: 483 - protein, 9 aa, Homo sapiens
GLLGVWTVL

SEQ ID NO: 484 - protein, 9 aa, Homo sapiens
LLGVWTVLL

SEQ ID NO: 485 - protein, 9 aa, Homo sapiens
GVWTVLLLL

SEQ ID NO: 486 - protein, 9 aa, Homo sapiens
LHNVGLLGV

SEQ ID NO: 487 - protein, 9 aa, Homo sapiens
GLLGSWTVL

SEQ ID NO: 488 - protein, 9 aa, Homo sapiens
LLGSWTVLL

SEQ ID NO: 489 - protein, 9 aa, Homo sapiens
RRFPEELGY

SEQ ID NO: 490 - protein, 9 aa, Homo sapiens
TRLPANGQM

SEQ ID NO: 491 - protein, 9 aa, Homo sapiens
LLFGAKYGI

SEQ ID NO: 492 - protein, 9 aa, Homo sapiens
YIALLFGAK

SEQ ID NO: 493 - protein, 9 aa, Homo sapiens
RESYIALLF

SEQ ID NO: 494 - protein, 9 aa, Homo sapiens
EEDKVSVTF

SEQ ID NO: 495 - protein, 9 aa, Homo sapiens
RRWGLPHRI

SEQ ID NO: 496 - protein, 9 aa, Homo sapiens
HRIHESLSL

SEQ ID NO: 497 - protein, 9 aa, Homo sapiens
SVGQDLLLY

SEQ ID NO: 498 - protein, 9 aa, Homo sapiens
SLFSELSPV

SEQ ID NO: 499 - protein, 9 aa, Homo sapiens
TVAPVSVPR

SEQ ID NO: 500 - protein, 9 aa, Homo sapiens
IRRRNLRNI

SEQ ID NO: 501 - protein, 9 aa, Homo sapiens
FRGPQGRVV

SEQ ID NO: 502 - protein, 9 aa, Homo sapiens
MGNPCESFV

SEQ ID NO: 503 - protein, 9 aa, Homo sapiens
NPCESFVDI

SEQ ID NO: 504 - protein, 9 aa, Homo sapiens
PEIVGHPAF

SEQ ID NO: 505 - protein, 9 aa, Homo sapiens
ATFMDGKLI

SEQ ID NO: 506 - protein, 9 aa, Homo sapiens
FMDGKLILL

SEQ ID NO: 507 - protein, 9 aa, Homo sapiens
ILLLWSCTV

SEQ ID NO: 508 - protein, 9 aa, Homo sapiens
SPQEDKVVI

SEQ ID NO: 509 - protein, 9 aa, Homo sapiens
RLIQALPTV

SEQ ID NO: 510 - protein, 9 aa, Homo sapiens
MLQHFKVTI

SEQ ID NO: 511 - protein, 9 aa, Homo sapiens
KQRSFCSTV

SEQ ID NO: 512 - protein, 9 aa, Homo sapiens
DPFALGGTV

SEQ ID NO: 513 - protein, 9 aa, Homo sapiens
FALGGTVVA

SEQ ID NO: 514 - protein, 9 aa, Homo sapiens
QMLSVSATY

SEQ ID NO: 515 - protein, 9 aa, Homo sapiens
QMLSVSATY

SEQ ID NO: 516 - protein, 9 aa, Homo sapiens
HMLMPQRVI

SEQ ID NO: 517 - protein, 9 aa, Homo sapiens
APSLRWLFY

SEQ ID NO: 518 - protein, 9 aa, Homo sapiens
ILLSGPRSL

SEQ ID NO: 519 - protein, 9 aa, Homo sapiens
YINAKPKLF

SEQ ID NO: 520 - protein, 9 aa, Homo sapiens
NAKPKLFSM

SEQ ID NO: 521 - protein, 9 aa, Homo sapiens
SEVTTQSAL

SEQ ID NO: 522 - protein, 9 aa, Homo sapiens
FISESEYTY

SEQ ID NO: 523 - protein, 9 aa, Homo sapiens
FISESEYTY

SEQ ID NO: 524 - protein, 9 aa, Homo sapiens
SESEYTYAL

SEQ ID NO: 525 - protein, 9 aa, Homo sapiens
SEYTYALKE

SEQ ID NO: 526 - protein, 9 aa, Homo sapiens
FISESEYTY

SEQ ID NO: 527 - protein, 9 aa, Homo sapiens
LSLQHLEKY

SEQ ID NO: 528 - protein, 9 aa, Homo sapiens
QARLSLQHL

SEQ ID NO: 529 - protein, 9 aa, Homo sapiens
LSLQHLEKY

SEQ ID NO: 530 - protein, 9 aa, Homo sapiens
VVIMAIIFY

SEQ ID NO: 531 - protein, 9 aa, Homo sapiens
VVVVIMAII

SEQ ID NO: 532 - protein, 9 aa, Homo sapiens
KAAVLNQHY

SEQ ID NO: 533 - protein, 9 aa, Homo sapiens
KAMESYKHY

SEQ ID NO: 534 - protein, 9 aa, Homo sapiens
WSTNHDKVV

SEQ ID NO: 535 - protein, 9 aa, Homo sapiens
AMYICCLLM

SEQ ID NO: 536 - protein, 9 aa, Homo sapiens
NAMYICCLL

SEQ ID NO: 537 - protein, 9 aa, Homo sapiens
YICCLLMLL

SEQ ID NO: 538 - protein, 9 aa, Homo sapiens
WHDGVNRFF

SEQ ID NO: 539 - protein, 9 aa, Homo sapiens
IGGDNLSTL

SEQ ID NO: 540 - protein, 9 aa, Homo sapiens
QAQSLNKLV

SEQ ID NO: 541 - protein, 9 aa, Homo sapiens
ITFDNWLLL

SEQ ID NO: 542 - protein, 9 aa, Homo sapiens
TFDNWLLLH

SEQ ID NO: 543 - protein, 9 aa, Homo sapiens
LLLHGRRSY

SEQ ID NO: 544 - protein, 9 aa, Homo sapiens
ITFDNWLLL

SEQ ID NO: 545 - protein, 9 aa, Homo sapiens
VHSKQVFAL

SEQ ID NO: 546 - protein, 9 aa, Homo sapiens
FEGCIMQLF

SEQ ID NO: 547 - protein, 9 aa, Homo sapiens
ASYSSSVTL

SEQ ID NO: 548 - protein, 9 aa, Homo sapiens
YSSSVTLKM

SEQ ID NO: 549 - protein, 9 aa, Homo sapiens
TAKELTTFL

SEQ ID NO: 550 - protein, 9 aa, Homo sapiens
FPDHSQQLL

SEQ ID NO: 551 - protein, 9 aa, Homo sapiens
QTDELTLMT

SEQ ID NO: 552 - protein, 9 aa, Homo sapiens
YNIPQTDEL

SEQ ID NO: 553 - protein, 9 aa, Homo sapiens
LTLMTIAYV

SEQ ID NO: 554 - protein, 9 aa, Homo sapiens
FLDQDQSPL

SEQ ID NO: 555 - protein, 9 aa, Homo sapiens
LAAATLGVF

SEQ ID NO: 556 - protein, 9 aa, Homo sapiens
GVFCLGLVV

SEQ ID NO: 557 - protein, 9 aa, Homo sapiens
FCLGLVVTI

SEQ ID NO: 558 - protein, 9 aa, Homo sapiens
KHSEHRPSL

SEQ ID NO: 559 - protein, 9 aa, Homo sapiens
RPFLVSVML

SEQ ID NO: 560 - protein, 9 aa, Homo sapiens
VMLRSIYTI

SEQ ID NO: 561 - protein, 9 aa, Homo sapiens
FLLNGLSVL

SEQ ID NO: 562 - protein, 9 aa, Homo sapiens
FLLNGSSVL

SEQ ID NO: 563 - protein, 9 aa, Homo sapiens
FSLFYWNPY

SEQ ID NO: 564 - protein, 9 aa, Homo sapiens
RCKDFSLFY

SEQ ID NO: 565 - protein, 9 aa, Homo sapiens
FSLFYWNPY

SEQ ID NO: 566 - protein, 9 aa, Homo sapiens
LFYWNPYWM

SEQ ID NO: 567 - protein, 9 aa, Homo sapiens
FSLFYWNPY

SEQ ID NO: 568 - protein, 9 aa, Homo sapiens
FYWNPYWML

SEQ ID NO: 569 - protein, 9 aa, Homo sapiens
LNDDIINFY

SEQ ID NO: 570 - protein, 9 aa, Homo sapiens
KTHLGALMY

SEQ ID NO: 571 - protein, 9 aa, Homo sapiens
KTHLGALMY

SEQ ID NO: 572 - protein, 9 aa, Homo sapiens
TIMKFLKMV

SEQ ID NO: 573 - protein, 9 aa, Homo sapiens
MKFLKMVNI

SEQ ID NO: 574 - protein, 9 aa, Homo sapiens
VVRELILRY

SEQ ID NO: 575 - protein, 9 aa, Homo sapiens
KALGLVILL

SEQ ID NO: 576 - protein, 9 aa, Homo sapiens
FEEAPDYMY

SEQ ID NO: 577 - protein, 9 aa, Homo sapiens
FEEAPDYMY

SEQ ID NO: 578 - protein, 9 aa, Homo sapiens
LTQADCFTY

SEQ ID NO: 579 - protein, 9 aa, Homo sapiens
MMLIGTLTQ

SEQ ID NO: 580 - protein, 9 aa, Homo sapiens
LTQADCFTY

SEQ ID NO: 581 - protein, 9 aa, Homo sapiens
YVLDSIDEA

SEQ ID NO: 582 - protein, 9 aa, Homo sapiens
FTKEKEAFI

SEQ ID NO: 583 - protein, 9 aa, Homo sapiens
TVLEKLLPL

SEQ ID NO: 584 - protein, 9 aa, Homo sapiens
LPLDQKLKY

SEQ ID NO: 585 - protein, 9 aa, Homo sapiens
ELRENSIVV

SEQ ID NO: 586 - protein, 9 aa, Homo sapiens
FIFHNTTTS

SEQ ID NO: 587 - protein, 9 aa, Homo sapiens
SADFHAKEI

SEQ ID NO: 588 - protein, 9 aa, Homo sapiens
HAKEIFSTC

SEQ ID NO: 589 - protein, 9 aa, Homo sapiens
TSGSIPPNY

SEQ ID NO: 590 - protein, 9 aa, Homo sapiens
GSIPPNYQY

SEQ ID NO: 591 - protein, 9 aa, Homo sapiens
SIPPNYQYI

SEQ ID NO: 592 - protein, 9 aa, Homo sapiens
GSSEEASFY

SEQ ID NO: 593 - protein, 9 aa, Homo sapiens
SSEEASFYY

SEQ ID NO: 594 - protein, 9 aa, Homo sapiens
GSSEEASFY

SEQ ID NO: 595 - protein, 9 aa, Homo sapiens
SSEEASFYY

SEQ ID NO: 596 - protein, 9 aa, Homo sapiens
AGFWIIHLY

SEQ ID NO: 597 - protein, 9 aa, Homo sapiens
GFWIIHLYS

SEQ ID NO: 598 - protein, 9 aa, Homo sapiens
WIIHLYSDF

SEQ ID NO: 599 - protein, 9 aa, Homo sapiens
HLYSDFRFY

SEQ ID NO: 600 - protein, 9 aa, Homo sapiens
SAGFWIIHL

SEQ ID NO: 601 - protein, 9 aa, Homo sapiens
HLYSDFRFY

SEQ ID NO: 602 - protein, 9 aa, Homo sapiens
HINDIIKIL

SEQ ID NO: 603 - protein, 9 aa, Homo sapiens
LAFIRANKA

SEQ ID NO: 604 - protein, 9 aa, Homo sapiens
ETDEGEIQY

SEQ ID NO: 605 - protein, 9 aa, Homo sapiens
FRFGVALGL

SEQ ID NO: 606 - protein, 9 aa, Homo sapiens
GAFRFGVAL

SEQ ID NO: 607 - protein, 9 aa, Homo sapiens
QSLLTQLLY

SEQ ID NO: 608 - protein, 9 aa, Homo sapiens
QSLLTQLLY

SEQ ID NO: 609 - protein, 9 aa, Homo sapiens
FDEDLNDKI

SEQ ID NO: 610 - protein, 9 aa, Homo sapiens
NRLSPDSSL

SEQ ID NO: 611 - protein, 9 aa, Homo sapiens
KSGAHINAV

SEQ ID NO: 612 - protein, 9 aa, Homo sapiens
AEASMVHML

SEQ ID NO: 613 - protein, 9 aa, Homo sapiens
PAEASMVHM

SEQ ID NO: 614 - protein, 9 aa, Homo sapiens
ISKGPGLEV

SEQ ID NO: 615 - protein, 9 aa, Homo sapiens
LSFCANHDI

SEQ ID NO: 616 - protein, 9 aa, Homo sapiens
CANHDIPHF

SEQ ID NO: 617 - protein, 9 aa, Homo sapiens
AEIEALAAI

SEQ ID NO: 618 - protein, 9 aa, Homo sapiens
LAAIKMREL

SEQ ID NO: 619 - protein, 9 aa, Homo sapiens
RMPEAAPAV

SEQ ID NO: 620 - protein, 9 aa, Homo sapiens
SPSELSPPI

SEQ ID NO: 621 - protein, 9 aa, Homo sapiens
MEHPKCEWF

SEQ ID NO: 622 - protein, 9 aa, Homo sapiens
LGTGTSILY

SEQ ID NO: 623 - protein, 9 aa, Homo sapiens
FAYMWTINN

SEQ ID NO: 624 - protein, 9 aa, Homo sapiens
FCIALSLSI

SEQ ID NO: 625 - protein, 9 aa, Homo sapiens
DRIKDNEVL

SEQ ID NO: 626 - protein, 9 aa, Homo sapiens
SAMKNLMKY

SEQ ID NO: 627 - protein, 9 aa, Homo sapiens
SAMKNLMKY

SEQ ID NO: 628 - protein, 9 aa, Homo sapiens
MKYSSQALV

SEQ ID NO: 629 - protein, 9 aa, Homo sapiens
SQKEFVRLY

SEQ ID NO: 630 - protein, 9 aa, Homo sapiens
FPKTNLKPV

SEQ ID NO: 631 - protein, 9 aa, Homo sapiens
LEKWLRPFY

SEQ ID NO: 632 - protein, 9 aa, Homo sapiens
WLRPFYRVL

SEQ ID NO: 633 - protein, 9 aa, Homo sapiens
CPRPQACVV

SEQ ID NO: 634 - protein, 9 aa, Homo sapiens
LPPDAFIHM

SEQ ID NO: 635 - protein, 9 aa, Homo sapiens
DAFIHMDDF

SEQ ID NO: 636 - protein, 9 aa, Homo sapiens
QPAVLGTTV

SEQ ID NO: 637 - protein, 9 aa, Homo sapiens
DMDKNLEPV

SEQ ID NO: 638 - protein, 9 aa, Homo sapiens
VTQNDTGFY

SEQ ID NO: 639 - protein, 9 aa, Homo sapiens
VTQNDTGFY

SEQ ID NO: 640 - protein, 9 aa, Homo sapiens
PAPPPTLHL

SEQ ID NO: 641 - protein, 9 aa, Homo sapiens
VPDPAGTSL

SEQ ID NO: 642 - protein, 9 aa, Homo sapiens
KAFRHRSNF

SEQ ID NO: 643 - protein, 9 aa, Homo sapiens
LSGDSVMTI

SEQ ID NO: 644 - protein, 9 aa, Homo sapiens
LLAHPGLLV

SEQ ID NO: 645 - protein, 9 aa, Homo sapiens
EEDQAMRAF

SEQ ID NO: 646 - protein, 9 aa, Homo sapiens
KMFMRGRTI

SEQ ID NO: 647 - protein, 9 aa, Homo sapiens
FMRGRTITM

SEQ ID NO: 648 - protein, 9 aa, Homo sapiens
LQIPPGPPI

SEQ ID NO: 649 - protein, 9 aa, Homo sapiens
VTRRIGHPY

SEQ ID NO: 650 - protein, 9 aa, Homo sapiens
SPFSVTRRI

SEQ ID NO: 651 - protein, 9 aa, Homo sapiens
PGSPKVYLY

SEQ ID NO: 652 - protein, 9 aa, Homo sapiens
FEAENLDSI

SEQ ID NO: 653 - protein, 9 aa, Homo sapiens
EEFLSFFGH

SEQ ID NO: 654 - protein, 9 aa, Homo sapiens
FFGHSTRIV

SEQ ID NO: 655 - protein, 9 aa, Homo sapiens
MAPTSGPVF

SEQ ID NO: 656 - protein, 9 aa, Homo sapiens
RAESSEFTV

SEQ ID NO: 657 - protein, 9 aa, Homo sapiens
AEVVHVKVH

SEQ ID NO: 658 - protein, 9 aa, Homo sapiens
RAEVVHVKV

SEQ ID NO: 659 - protein, 9 aa, Homo sapiens
VMKKDSGQY

SEQ ID NO: 660 - protein, 9 aa, Homo sapiens
GVMAWRRMV

SEQ ID NO: 661 - protein, 9 aa, Homo sapiens
KATSARPSV

SEQ ID NO: 662 - protein, 9 aa, Homo sapiens
DAHTSLSAL

SEQ ID NO: 663 - protein, 9 aa, Homo sapiens
MLANNNLHI

SEQ ID NO: 664 - protein, 9 aa, Homo sapiens
LANNNLHIL

SEQ ID NO: 665 - protein, 9 aa, Homo sapiens
YTEEEPEWL

SEQ ID NO: 666 - protein, 9 aa, Homo sapiens
RPAPDRPTM

SEQ ID NO: 667 - protein, 9 aa, Homo sapiens
PSLEIYKKI

SEQ ID NO: 668 - protein, 9 aa, Homo sapiens
EIYKKIFEV

SEQ ID NO: 669 - protein, 9 aa, Homo sapiens
STFEAIIQY

SEQ ID NO: 670 - protein, 9 aa, Homo sapiens
FIKITLSTF

SEQ ID NO: 671 - protein, 9 aa, Homo sapiens
ITLSTFEAI

SEQ ID NO: 672 - protein, 9 aa, Homo sapiens
STFEAIIQY

SEQ ID NO: 673 - protein, 9 aa, Homo sapiens
STLGLALKF

SEQ ID NO: 674 - protein, 9 aa, Homo sapiens
TLGLALKFY

SEQ ID NO: 675 - protein, 9 aa, Homo sapiens
GLALKFYNY

SEQ ID NO: 676 - protein, 9 aa, Homo sapiens
FHPEECRVI

SEQ ID NO: 677 - protein, 9 aa, Homo sapiens
IAVILANTV

SEQ ID NO: 678 - protein, 9 aa, Homo sapiens
LANTVAQSL

SEQ ID NO: 679 - protein, 9 aa, Homo sapiens
AEVDNCLAD

SEQ ID NO: 680 - protein, 9 aa, Homo sapiens
VQYERRQSI

SEQ ID NO: 681 - protein, 9 aa, Homo sapiens
YERRQSICV

SEQ ID NO: 682 - protein, 9 aa, Homo sapiens
IESDEVRNV

SEQ ID NO: 683 - protein, 9 aa, Homo sapiens
YEILPGRLL

SEQ ID NO: 684 - protein, 9 aa, Homo sapiens
YEILPGRLL

SEQ ID NO: 685 - protein, 9 aa, Homo sapiens
YIYVPHPDV

SEQ ID NO: 686 - protein, 9 aa, Homo sapiens
YVPHPDVAF

SEQ ID NO: 687 - protein, 9 aa, Homo sapiens
VPHPDVAFV

SEQ ID NO: 688 - protein, 9 aa, Homo sapiens
GVYNRVTAY

SEQ ID NO: 689 - protein, 9 aa, Homo sapiens
GVYNRVTAY

SEQ ID NO: 690 - protein, 9 aa, Homo sapiens
FIHEYISEY

SEQ ID NO: 691 - protein, 9 aa, Homo sapiens
SEYYRVSSY

SEQ ID NO: 692 - protein, 9 aa, Homo sapiens
FIHEYISEY

SEQ ID NO: 693 - protein, 9 aa, Homo sapiens
SEYYRVSSY

SEQ ID NO: 694 - protein, 9 aa, Homo sapiens
EANDLALCL

SEQ ID NO: 695 - protein, 9 aa, Homo sapiens
LALCLARQF

SEQ ID NO: 696 - protein, 9 aa, Homo sapiens
GFMIQDGLF

SEQ ID NO: 697 - protein, 9 aa, Homo sapiens
LFGSCENKY

SEQ ID NO: 698 - protein, 9 aa, Homo sapiens
TSYMWNNHI

SEQ ID NO: 699 - protein, 9 aa, Homo sapiens
WGIQLAALY

SEQ ID NO: 700 - protein, 9 aa, Homo sapiens
LSSSRTLTI

SEQ ID NO: 701 - protein, 9 aa, Homo sapiens
RSCSRREKV

SEQ ID NO: 702 - protein, 9 aa, Homo sapiens
QLMGNRFHF

SEQ ID NO: 703 - protein, 9 aa, Homo sapiens
DMNDHAPEV

SEQ ID NO: 704 - protein, 9 aa, Homo sapiens
QIHQLVAAY

SEQ ID NO: 705 - protein, 9 aa, Homo sapiens
LASRTNEQI

SEQ ID NO: 706 - protein, 9 aa, Homo sapiens
ELKPCVKTY

SEQ ID NO: 707 - protein, 9 aa, Homo sapiens
YGLHEGQRV

SEQ ID NO: 708 - protein, 9 aa, Homo sapiens
TRNGCSILL

SEQ ID NO: 709 - protein, 9 aa, Homo sapiens
VTRNGCSIL

SEQ ID NO: 710 - protein, 9 aa, Homo sapiens
YEMNSSIKL

SEQ ID NO: 711 - protein, 9 aa, Homo sapiens
RIYEMNSSI

SEQ ID NO: 712 - protein, 9 aa, Homo sapiens
YEMNSSIKL

SEQ ID NO: 713 - protein, 9 aa, Homo sapiens
KVTESSPNY

SEQ ID NO: 714 - protein, 9 aa, Homo sapiens
LSLPMYLVF

SEQ ID NO: 715 - protein, 9 aa, Homo sapiens
LVFKRCLPL

SEQ ID NO: 716 - protein, 9 aa, Homo sapiens
YPKVKLKIM

SEQ ID NO: 717 - protein, 9 aa, Homo sapiens
AEIQDKWKS

SEQ ID NO: 718 - protein, 9 aa, Homo sapiens
EHDFVIMKI

SEQ ID NO: 719 - protein, 9 aa, Homo sapiens
IMKIPFKMV

SEQ ID NO: 720 - protein, 9 aa, Homo sapiens
DEKPPFKSI

SEQ ID NO: 721 - protein, 9 aa, Homo sapiens
FRAWKTKLI

SEQ ID NO: 722 - protein, 9 aa, Homo sapiens
FHESSTPSI

SEQ ID NO: 723 - protein, 9 aa, Homo sapiens
FHESSTPSI

SEQ ID NO: 724 - protein, 9 aa, Homo sapiens
PAANEVPRI

SEQ ID NO: 725 - protein, 9 aa, Homo sapiens
AANEVPRII

SEQ ID NO: 726 - protein, 9 aa, Homo sapiens
TELHIAALY

SEQ ID NO: 727 - protein, 9 aa, Homo sapiens
TELHIAALY

SEQ ID NO: 728 - protein, 9 aa, Homo sapiens
TTLHIAALY

SEQ ID NO: 729 - protein, 9 aa, Homo sapiens
TTLHIAALY

SEQ ID NO: 730 - protein, 9 aa, Homo sapiens
MYFFLSLLA

SEQ ID NO: 731 - protein, 9 aa, Homo sapiens
LLAIIDMSY

SEQ ID NO: 732 - protein, 9 aa, Homo sapiens
PMYFFLSLL

SEQ ID NO: 733 - protein, 9 aa, Homo sapiens
YFFLSLLAI

SEQ ID NO: 734 - protein, 9 aa, Homo sapiens
FFLSLLAII

SEQ ID NO: 735 - protein, 9 aa, Homo sapiens
FAQKCFKNC

SEQ ID NO: 736 - protein, 9 aa, Homo sapiens
LLFGCGETY

SEQ ID NO: 737 - protein, 9 aa, Homo sapiens
LLFGCGETY

SEQ ID NO: 738 - protein, 9 aa, Homo sapiens
LPEPMLKSI

SEQ ID NO: 739 - protein, 9 aa, Homo sapiens
SEMLVACCM

SEQ ID NO: 740 - protein, 9 aa, Homo sapiens
MFADSINRM

SEQ ID NO: 741 - protein, 9 aa, Homo sapiens
NICDKPAKV

SEQ ID NO: 742 - protein, 9 aa, Homo sapiens
RVKKRINTY

SEQ ID NO: 743 - protein, 9 aa, Homo sapiens
FKGESLGRI

SEQ ID NO: 744 - protein, 9 aa, Homo sapiens
FNPHFHVEY

SEQ ID NO: 745 - protein, 9 aa, Homo sapiens
FHVEYEWNL

SEQ ID NO: 746 - protein, 9 aa, Homo sapiens
LESFRIMDY

SEQ ID NO: 747 - protein, 9 aa, Homo sapiens
FRIMDYSLL

SEQ ID NO: 748 - protein, 9 aa, Homo sapiens
RVLESFRIM

SEQ ID NO: 749 - protein, 9 aa, Homo sapiens
FSTVISMLY

SEQ ID NO: 750 - protein, 9 aa, Homo sapiens
STVISMLYY

SEQ ID NO: 751 - protein, 9 aa, Homo sapiens
FSTVISMLY

SEQ ID NO: 752 - protein, 9 aa, Homo sapiens
STVISMLYY

SEQ ID NO: 753 - protein, 9 aa, Homo sapiens
IVVFFSTVI

SEQ ID NO: 754 - protein, 9 aa, Homo sapiens
RARDNNCSY

SEQ ID NO: 755 - protein, 9 aa, Homo sapiens
DPTPIAASL

SEQ ID NO: 756 - protein, 9 aa, Homo sapiens
NADHLRSAV

SEQ ID NO: 757 - protein, 9 aa, Homo sapiens
HHAPVLLSW

SEQ ID NO: 758 - protein, 9 aa, Homo sapiens
FTYERRPIS

SEQ ID NO: 759 - protein, 9 aa, Homo sapiens
MPFPGQHSM

SEQ ID NO: 760 - protein, 9 aa, Homo sapiens
AEVFRHPAF

SEQ ID NO: 761 - protein, 9 aa, Homo sapiens
EVFRHPAFI

SEQ ID NO: 762 - protein, 9 aa, Homo sapiens
YTHSFPSQY

SEQ ID NO: 763 - protein, 9 aa, Homo sapiens
YTHSFPSQY

SEQ ID NO: 764 - protein, 9 aa, Homo sapiens
VHGSYTHSF

SEQ ID NO: 765 - protein, 9 aa, Homo sapiens
YTHSFPSQY

SEQ ID NO: 766 - protein, 9 aa, Homo sapiens
SAQFALVTL

SEQ ID NO: 767 - protein, 9 aa, Homo sapiens
HAGFPGPFI

SEQ ID NO: 768 - protein, 9 aa, Homo sapiens
FQVCADKFL

SEQ ID NO: 769 - protein, 9 aa, Homo sapiens
VNHSTAPYY

SEQ ID NO: 770 - protein, 9 aa, Homo sapiens
NIFGPMASV

SEQ ID NO: 771 - protein, 9 aa, Homo sapiens
MSLGPMGSL

SEQ ID NO: 772 - protein, 9 aa, Homo sapiens
LCSRRVSMI

SEQ ID NO: 773 - protein, 9 aa, Homo sapiens
VPLEARPVL

SEQ ID NO: 774 - protein, 9 aa, Homo sapiens
DPVRRNARI

SEQ ID NO: 775 - protein, 9 aa, Homo sapiens
FSGVFIGVI

SEQ ID NO: 776 - protein, 9 aa, Homo sapiens
DEDDDVPSI

SEQ ID NO: 777 - protein, 9 aa, Homo sapiens
DEDDDVPSI

SEQ ID NO: 778 - protein, 9 aa, Homo sapiens
RLLYRTVDR

SEQ ID NO: 779 - protein, 9 aa, Homo sapiens
LEEQKRLLY

SEQ ID NO: 780 - protein, 9 aa, Homo sapiens
LLYRTVDRL

SEQ ID NO: 781 - protein, 9 aa, Homo sapiens
QAEERSKLL

SEQ ID NO: 782 - protein, 9 aa, Homo sapiens
HFFCDTPTV

SEQ ID NO: 783 - protein, 9 aa, Homo sapiens
FFCDTPTVL

SEQ ID NO: 784 - protein, 9 aa, Homo sapiens
FSYSGQWKV

SEQ ID NO: 785 - protein, 9 aa, Homo sapiens
TVIIFPAEY

SEQ ID NO: 786 - protein, 9 aa, Homo sapiens
LLCDHPVPV

SEQ ID NO: 787 - protein, 9 aa, Homo sapiens
HVRQGMRRK

SEQ ID NO: 788 - protein, 9 aa, Homo sapiens
LAEDRTRVV

SEQ ID NO: 789 - protein, 9 aa, Homo sapiens
TAKSGVLSV

SEQ ID NO: 790 - protein, 9 aa, Homo sapiens
AMFVLLHRH

SEQ ID NO: 791 - protein, 9 aa, Homo sapiens
RHYDGIGGL

SEQ ID NO: 792 - protein, 9 aa, Homo sapiens
RQANLLMGK

SEQ ID NO: 793 - protein, 9 aa, Homo sapiens
LLMGKQLLR

SEQ ID NO: 794 - protein, 9 aa, Homo sapiens
RQANLLMGK

SEQ ID NO: 795 - protein, 9 aa, Homo sapiens
AIFTYTRPK

SEQ ID NO: 796 - protein, 9 aa, Homo sapiens
GAAIFTYTR

SEQ ID NO: 797 - protein, 9 aa, Homo sapiens
AIFTYTRPK

SEQ ID NO: 798 - protein, 9 aa, Homo sapiens
FTYTRPKSH

SEQ ID NO: 799 - protein, 9 aa, Homo sapiens
YSCKVQSTI

SEQ ID NO: 800 - protein, 9 aa, Homo sapiens
STVVCTSTR

SEQ ID NO: 801 - protein, 9 aa, Homo sapiens
VTLASEACR

SEQ ID NO: 802 - protein, 9 aa, Homo sapiens
NEALGCELM

SEQ ID NO: 803 - protein, 9 aa, Homo sapiens
EALGCELML

SEQ ID NO: 804 - protein, 9 aa, Homo sapiens
YVMIFRDVM

SEQ ID NO: 805 - protein, 9 aa, Homo sapiens
LIHRFGHCV

SEQ ID NO: 806 - protein, 9 aa, Homo sapiens
FGHCVPPPV

SEQ ID NO: 807 - protein, 9 aa, Homo sapiens
DSLLILFPY

SEQ ID NO: 808 - protein, 9 aa, Homo sapiens
LILFPYALI

SEQ ID NO: 809 - protein, 9 aa, Homo sapiens
ILFPYALIL

SEQ ID NO: 810 - protein, 9 aa, Homo sapiens
FPYALILRT

SEQ ID NO: 811 - protein, 9 aa, Homo sapiens
YIYQFFENK

SEQ ID NO: 812 - protein, 9 aa, Homo sapiens
YIYQFFENK

SEQ ID NO: 813 - protein, 9 aa, Homo sapiens
YIYQFFENK

SEQ ID NO: 814 - protein, 9 aa, Homo sapiens
KGPRMPLLK

SEQ ID NO: 815 - protein, 9 aa, Homo sapiens
YVNNSLFFF

SEQ ID NO: 816 - protein, 9 aa, Homo sapiens
EVIPNGHIF

SEQ ID NO: 817 - protein, 9 aa, Homo sapiens
YTLKNAAMK

SEQ ID NO: 818 - protein, 9 aa, Homo sapiens
AAMKSAMRK

SEQ ID NO: 819 - protein, 9 aa, Homo sapiens
YTLKNAAMK

SEQ ID NO: 820 - protein, 9 aa, Homo sapiens
AAMKSAMRK

SEQ ID NO: 821 - protein, 9 aa, Homo sapiens
AIYLFTLMV

SEQ ID NO: 822 - protein, 9 aa, Homo sapiens
YLFTLMVNL

SEQ ID NO: 823 - protein, 9 aa, Homo sapiens
MVNLGLILV

SEQ ID NO: 824 - protein, 9 aa, Homo sapiens
LASTASPEK

SEQ ID NO: 825 - protein, 9 aa, Homo sapiens
ASTASPEKK

SEQ ID NO: 826 - protein, 9 aa, Homo sapiens
LTVRRWEEI

SEQ ID NO: 827 - protein, 9 aa, Homo sapiens
LPFSGFQAM

SEQ ID NO: 828 - protein, 9 aa, Homo sapiens
LPFSGFQAM

SEQ ID NO: 829 - protein, 9 aa, Homo sapiens
FQAMPEEFL

SEQ ID NO: 830 - protein, 9 aa, Homo sapiens
VVGADGVGK

SEQ ID NO: 831 - protein, 9 aa, Homo sapiens
TEATLSFVY

SEQ ID NO: 832 - protein, 9 aa, Homo sapiens
TSFQASGYY

SEQ ID NO: 833 - protein, 9 aa, Homo sapiens
TSFQASGYY

SEQ ID NO: 834 - protein, 9 aa, Homo sapiens
EVQPPSSPV

SEQ ID NO: 835 - protein, 9 aa, Homo sapiens
SQREEMLQK

SEQ ID NO: 836 - protein, 9 aa, Homo sapiens
YPPSQIARI

SEQ ID NO: 837 - protein, 9 aa, Homo sapiens
YPPSQIARI

SEQ ID NO: 838 - protein, 9 aa, Homo sapiens
HLVNHLCHY

SEQ ID NO: 839 - protein, 9 aa, Homo sapiens
GSKEVFYMY

SEQ ID NO: 840 - protein, 9 aa, Homo sapiens
YYLICLQHI

SEQ ID NO: 841 - protein, 9 aa, Homo sapiens
YLICLQHIL

SEQ ID NO: 842 - protein, 9 aa, Homo sapiens
KVIPLHESY

SEQ ID NO: 843 - protein, 9 aa, Homo sapiens
MDSELWPTV

SEQ ID NO: 844 - protein, 9 aa, Homo sapiens
KAAVMLKLL

SEQ ID NO: 845 - protein, 9 aa, Homo sapiens
DMRDSYLVY

SEQ ID NO: 846 - protein, 9 aa, Homo sapiens
LVYSTELAL

SEQ ID NO: 847 - protein, 9 aa, Homo sapiens
KVCSSVLGH

SEQ ID NO: 848 - protein, 9 aa, Homo sapiens
KVCSSVLGH

SEQ ID NO: 849 - protein, 9 aa, Homo sapiens
TAGEVELKV

SEQ ID NO: 850 - protein, 9 aa, Homo sapiens
CPLANRGVV

SEQ ID NO: 851 - protein, 9 aa, Homo sapiens
LANRGVVRW

SEQ ID NO: 852 - protein, 9 aa, Homo sapiens
RKREGELTV

SEQ ID NO: 853 - protein, 9 aa, Homo sapiens
HTLRMLAFR

SEQ ID NO: 854 - protein, 9 aa, Homo sapiens
HTLRMLAFR

SEQ ID NO: 855 - protein, 9 aa, Homo sapiens
SAQHTLRML

SEQ ID NO: 856 - protein, 9 aa, Homo sapiens
NPVEADYSY

SEQ ID NO: 857 - protein, 9 aa, Homo sapiens
MYVWYNLDK

SEQ ID NO: 858 - protein, 9 aa, Homo sapiens
IEELGKRNF

SEQ ID NO: 859 - protein, 9 aa, Homo sapiens
DIYQVTSSL

SEQ ID NO: 860 - protein, 9 aa, Homo sapiens
VIDEEIKKM

SEQ ID NO: 861 - protein, 9 aa, Homo sapiens
EEWEFQVTA

SEQ ID NO: 862 - protein, 9 aa, Homo sapiens
WEFQVTAFY

SEQ ID NO: 863 - protein, 9 aa, Homo sapiens
WEFQVTAFY

SEQ ID NO: 864 - protein, 9 aa, Homo sapiens
ALGCRKAIK

SEQ ID NO: 865 - protein, 9 aa, Homo sapiens
KALGCRKAI

SEQ ID NO: 866 - protein, 9 aa, Homo sapiens
HQMIHSGDK

SEQ ID NO: 867 - protein, 9 aa, Homo sapiens
IPFPSFLSW

SEQ ID NO: 868 - protein, 9 aa, Homo sapiens
IPFPSFLSW

SEQ ID NO: 869 - protein, 9 aa, Homo sapiens
LSVRQGPTV

SEQ ID NO: 870 - protein, 9 aa, Homo sapiens
YQCPICWLR

SEQ ID NO: 871 - protein, 9 aa, Homo sapiens
RIYPASTQL

SEQ ID NO: 872 - protein, 9 aa, Homo sapiens
QSQVNSQHV

SEQ ID NO: 873 - protein, 9 aa, Homo sapiens
NSQHVGHSV

SEQ ID NO: 874 - protein, 9 aa, Homo sapiens
VEAKWVEVM

SEQ ID NO: 875 - protein, 9 aa, Homo sapiens
MSKRRDMTV

SEQ ID NO: 876 - protein, 9 aa, Homo sapiens
ISGTMSCQK

SEQ ID NO: 877 - protein, 9 aa, Homo sapiens
ISGTMSCQK

SEQ ID NO: 878 - protein, 9 aa, Homo sapiens
VFSFNAPLK

SEQ ID NO: 879 - protein, 9 aa, Homo sapiens
FVFSFNAPL

SEQ ID NO: 880 - protein, 9 aa, Homo sapiens
FVLHDPEAL

SEQ ID NO: 881 - protein, 9 aa, Homo sapiens
CVDYSDELK

SEQ ID NO: 882 - protein, 9 aa, Homo sapiens
CPAPTPVPI

SEQ ID NO: 883 - protein, 9 aa, Homo sapiens
IPCPAPTPV

SEQ ID NO: 884 - protein, 9 aa, Homo sapiens
CPAPTPVPI

SEQ ID NO: 885 - protein, 9 aa, Homo sapiens
PAPTPVPIV

SEQ ID NO: 886 - protein, 9 aa, Homo sapiens
DTYRSSVSL

SEQ ID NO: 887 - protein, 9 aa, Homo sapiens
PATKEPDTI

SEQ ID NO: 888 - protein, 9 aa, Homo sapiens
TLRITKTMK

SEQ ID NO: 889 - protein, 9 aa, Homo sapiens
FVETLRITK

SEQ ID NO: 890 - protein, 9 aa, Homo sapiens
ETLRITKTM

SEQ ID NO: 891 - protein, 9 aa, Homo sapiens
QTLATFYLK

SEQ ID NO: 892 - protein, 9 aa, Homo sapiens
TLATFYLKY

SEQ ID NO: 893 - protein, 9 aa, Homo sapiens
YLKYVQIFR

SEQ ID NO: 894 - protein, 9 aa, Homo sapiens
QTLATFYLK

SEQ ID NO: 895 - protein, 9 aa, Homo sapiens
TLATFYLKY

SEQ ID NO: 896 - protein, 9 aa, Homo sapiens
LATFYLKYV

SEQ ID NO: 897 - protein, 9 aa, Homo sapiens
FYLKYVQIF

SEQ ID NO: 898 - protein, 9 aa, Homo sapiens
LQYTGWPAY

SEQ ID NO: 899 - protein, 9 aa, Homo sapiens
LQYTGWPAY

SEQ ID NO: 900 - protein, 9 aa, Homo sapiens
HASCCLPSV

SEQ ID NO: 901 - protein, 9 aa, Homo sapiens
MESFNAIPT

SEQ ID NO: 902 - protein, 9 aa, Homo sapiens
YTYFVKKKM

SEQ ID NO: 903 - protein, 9 aa, Homo sapiens
FVKKKMESF

SEQ ID NO: 904 - protein, 9 aa, Homo sapiens
KKMESFNAI

SEQ ID NO: 905 - protein, 9 aa, Homo sapiens
QSNCFPGIV

SEQ ID NO: 906 - protein, 9 aa, Homo sapiens
FPGIVQTTY

SEQ ID NO: 907 - protein, 9 aa, Homo sapiens
LLLGGTSRK

SEQ ID NO: 908 - protein, 9 aa, Homo sapiens
LLLGGTSRK

SEQ ID NO: 909 - protein, 9 aa, Homo sapiens
KVYILRADR

SEQ ID NO: 910 - protein, 9 aa, Homo sapiens
GIGKVYILR

SEQ ID NO: 911 - protein, 9 aa, Homo sapiens
KVYILRADR

SEQ ID NO: 912 - protein, 9 aa, Homo sapiens
LSLGIILFR

SEQ ID NO: 913 - protein, 9 aa, Homo sapiens
LSLGIILFR

SEQ ID NO: 914 - protein, 9 aa, Homo sapiens
IILFRYVEI

SEQ ID NO: 915 - protein, 9 aa, Homo sapiens
ILFRYVEIL

SEQ ID NO: 916 - protein, 9 aa, Homo sapiens
RYVEILRTL

SEQ ID NO: 917 - protein, 9 aa, Homo sapiens
TSASHVWSY

SEQ ID NO: 918 - protein, 9 aa, Homo sapiens
RKFTSASHV

SEQ ID NO: 919 - protein, 9 aa, Homo sapiens
WEHLAEVTL

SEQ ID NO: 920 - protein, 9 aa, Homo sapiens
FKWEHLAEV

SEQ ID NO: 921 - protein, 9 aa, Homo sapiens
LPKRDTNFV

SEQ ID NO: 922 - protein, 9 aa, Homo sapiens
YQCENCAKV

SEQ ID NO: 923 - protein, 9 aa, Homo sapiens
DSPDRPVPV

SEQ ID NO: 924 - protein, 9 aa, Homo sapiens
TNNTETVPK

SEQ ID NO: 925 - protein, 9 aa, Homo sapiens
SETNNTETV

SEQ ID NO: 926 - protein, 9 aa, Homo sapiens
FFFSHFGWL

SEQ ID NO: 927 - protein, 9 aa, Homo sapiens
FSHFGWLFV

SEQ ID NO: 928 - protein, 9 aa, Homo sapiens
KITSLEEAK

SEQ ID NO: 929 - protein, 9 aa, Homo sapiens
GSFVFAVRV

SEQ ID NO: 930 - protein, 9 aa, Homo sapiens
ATRCNRQKK

SEQ ID NO: 931 - protein, 9 aa, Homo sapiens
DPVLEQYPF

SEQ ID NO: 932 - protein, 9 aa, Homo sapiens
EQYPFDVFL

SEQ ID NO: 933 - protein, 9 aa, Homo sapiens
YPFDVFLSP

SEQ ID NO: 934 - protein, 9 aa, Homo sapiens
KIIYSISHY

SEQ ID NO: 935 - protein, 9 aa, Homo sapiens
IIYSISHYY

SEQ ID NO: 936 - protein, 9 aa, Homo sapiens
KIIYSISHY

SEQ ID NO: 937 - protein, 9 aa, Homo sapiens
IIYSISHYY

SEQ ID NO: 938 - protein, 9 aa, Homo sapiens
TLINAIKII

SEQ ID NO: 939 - protein, 9 aa, Homo sapiens
NAIKIIYSI

SEQ ID NO: 940 - protein, 9 aa, Homo sapiens
IIYSISHYY

SEQ ID NO: 941 - protein, 9 aa, Homo sapiens
AFQPCIPFK

SEQ ID NO: 942 - protein, 9 aa, Homo sapiens
VAFQPCIPF

SEQ ID NO: 943 - protein, 9 aa, Homo sapiens
RTKVCEMAR

SEQ ID NO: 944 - protein, 9 aa, Homo sapiens
DYYSHERCI

SEQ ID NO: 945 - protein, 9 aa, Homo sapiens
YYSHERCIL

SEQ ID NO: 946 - protein, 9 aa, Homo sapiens
YSHERCILI

SEQ ID NO: 947 - protein, 9 aa, Homo sapiens
KTMGFSFPR

SEQ ID NO: 948 - protein, 9 aa, Homo sapiens
KTMGFSFPR

SEQ ID NO: 949 - protein, 9 aa, Homo sapiens
FADPRCEKL

SEQ ID NO: 950 - protein, 9 aa, Homo sapiens
HLYGLHEGR

SEQ ID NO: 951 - protein, 9 aa, Homo sapiens
YGLHEGRRV

SEQ ID NO: 952 - protein, 9 aa, Homo sapiens
SALINEIIV

SEQ ID NO: 953 - protein, 9 aa, Homo sapiens
LINEIIVTM

SEQ ID NO: 954 - protein, 9 aa, Homo sapiens
TEIFYLFTS

SEQ ID NO: 955 - protein, 9 aa, Homo sapiens
IFYLFTSFL

SEQ ID NO: 956 - protein, 9 aa, Homo sapiens
GASHVFQFV

SEQ ID NO: 957 - protein, 9 aa, Homo sapiens
REYNMDLYV

SEQ ID NO: 958 - protein, 9 aa, Homo sapiens
HEFGRLLAI

SEQ ID NO: 959 - protein, 9 aa, Homo sapiens
HEFGRLLAI

SEQ ID NO: 960 - protein, 9 aa, Homo sapiens
ISLKKPSAV

SEQ ID NO: 961 - protein, 9 aa, Homo sapiens
FVVDPHHII

SEQ ID NO: 962 - protein, 9 aa, Homo sapiens
VVDPHHIII

SEQ ID NO: 963 - protein, 9 aa, Homo sapiens
AAVTFGMAI

SEQ ID NO: 964 - protein, 9 aa, Homo sapiens
FGMAIAAFY

SEQ ID NO: 965 - protein, 9 aa, Homo sapiens
DENTVQEEV

SEQ ID NO: 966 - protein, 9 aa, Homo sapiens
RAHFEIYLL

SEQ ID NO: 967 - protein, 9 aa, Homo sapiens
VTAKIDHGK

SEQ ID NO: 968 - protein, 9 aa, Homo sapiens
SGLARRPAK

SEQ ID NO: 969 - protein, 9 aa, Homo sapiens
CVDAIDVLK

SEQ ID NO: 970 - protein, 9 aa, Homo sapiens
FSTICVDAI

SEQ ID NO: 971 - protein, 9 aa, Homo sapiens
ICVDAIDVL

SEQ ID NO: 972 - protein, 9 aa, Homo sapiens
LPSSCRHVI

SEQ ID NO: 973 - protein, 9 aa, Homo sapiens
LIKRRGPYK

SEQ ID NO: 974 - protein, 9 aa, Homo sapiens
KTSPSLLDY

SEQ ID NO: 975 - protein, 9 aa, Homo sapiens
LIKRRGPYK

SEQ ID NO: 976 - protein, 9 aa, Homo sapiens
KTSPSLLDY

SEQ ID NO: 977 - protein, 9 aa, Homo sapiens
GMVQMTFLR

SEQ ID NO: 978 - protein, 9 aa, Homo sapiens
PSMPDSIWK

SEQ ID NO: 979 - protein, 9 aa, Homo sapiens
VVGLIQYLK

SEQ ID NO: 980 - protein, 9 aa, Homo sapiens
VVGLIQYLK

SEQ ID NO: 981 - protein, 9 aa, Homo sapiens
IQYLKPNTI

SEQ ID NO: 982 - protein, 9 aa, Homo sapiens
YLKPNTIMV

SEQ ID NO: 983 - protein, 9 aa, Homo sapiens
LDSESSFTY

SEQ ID NO: 984 - protein, 9 aa, Homo sapiens
HTVYGKPRK

SEQ ID NO: 985 - protein, 9 aa, Homo sapiens
HTVYGKPRK

SEQ ID NO: 986 - protein, 9 aa, Homo sapiens
TVYGKPRKL

SEQ ID NO: 987 - protein, 9 aa, Homo sapiens
SLWRGTVPK

SEQ ID NO: 988 - protein, 9 aa, Homo sapiens
KLFADKIPK

SEQ ID NO: 989 - protein, 9 aa, Homo sapiens
FADKIPKTA

SEQ ID NO: 990 - protein, 9 aa, Homo sapiens
FLDEGTCVA

SEQ ID NO: 991 - protein, 9 aa, Homo sapiens
FLDEGTCVA

SEQ ID NO: 992 - protein, 9 aa, Homo sapiens
TMRDTIKYV

SEQ ID NO: 993 - protein, 9 aa, Homo sapiens
GLTIHAVRV

SEQ ID NO: 994 - protein, 9 aa, Homo sapiens
TIHAVRVTK

SEQ ID NO: 995 - protein, 9 aa, Homo sapiens
KMVAVFYNT

SEQ ID NO: 996 - protein, 9 aa, Homo sapiens
MVAVFYNTV

SEQ ID NO: 997 - protein, 9 aa, Homo sapiens
SLGEVGHHV

SEQ ID NO: 998 - protein, 9 aa, Homo sapiens
GEVGHHVDL

SEQ ID NO: 999 - protein, 9 aa, Homo sapiens
SLSDIKVAA

SEQ ID NO: 1000 - protein, 9 aa, Homo sapiens
KASRNGSTF

SEQ ID NO: 1001 - protein, 9 aa, Homo sapiens
YGWPTTITV

SEQ ID NO: 1002 - protein, 9 aa, Homo sapiens
HLDDRETCN

SEQ ID NO: 1003 - protein, 9 aa, Homo sapiens
YVTAMDIFV

SEQ ID NO: 1004 - protein, 9 aa, Homo sapiens
TAMDIFVTV

SEQ ID NO: 1005 - protein, 9 aa, Homo sapiens
LELVNRFPQ

SEQ ID NO: 1006 - protein, 9 aa, Homo sapiens
LELVNRFPQ

SEQ ID NO: 1007 - protein, 9 aa, Homo sapiens
EEGPAPEPY

SEQ ID NO: 1008 - protein, 9 aa, Homo sapiens
LLGLVLEGI

SEQ ID NO: 1009 - protein, 9 aa, Homo sapiens
LVLEGIVLA

SEQ ID NO: 1010 - protein, 9 aa, Homo sapiens
VLEGIVLAV

SEQ ID NO: 1011 - protein, 9 aa, Homo sapiens
LQGAKLIAV

SEQ ID NO: 1012 - protein, 9 aa, Homo sapiens
VMLQLLAMT

SEQ ID NO: 1013 - protein, 9 aa, Homo sapiens
MLQLLAMTV

SEQ ID NO: 1014 - protein, 9 aa, Homo sapiens
LLAMTVPNV

SEQ ID NO: 1015 - protein, 9 aa, Homo sapiens
MTVPNVLTF

SEQ ID NO: 1016 - protein, 9 aa, Homo sapiens
SVMLQLLAI

SEQ ID NO: 1017 - protein, 9 aa, Homo sapiens
MLQLLAIKV

SEQ ID NO: 1018 - protein, 9 aa, Homo sapiens
LLAIKVPNV

SEQ ID NO: 1019 - protein, 9 aa, Homo sapiens
VMLQLLAIK

SEQ ID NO: 1020 - protein, 9 aa, Homo sapiens
YLQDSMATT

SEQ ID NO: 1021 - protein, 9 aa, Homo sapiens
FLMTLETNM

SEQ ID NO: 1022 - protein, 9 aa, Homo sapiens
MTLETNMNL

SEQ ID NO: 1023 - protein, 9 aa, Homo sapiens
NMNLTKLGK

SEQ ID NO: 1024 - protein, 9 aa, Homo sapiens
LETNMNLTK

SEQ ID NO: 1025 - protein, 9 aa, Homo sapiens
EESETEGPM

SEQ ID NO: 1026 - protein, 9 aa, Homo sapiens
HDELAYWGI

SEQ ID NO: 1027 - protein, 9 aa, Homo sapiens
MDLGLALLL

SEQ ID NO: 1028 - protein, 9 aa, Homo sapiens
DEIVRLWDV

SEQ ID NO: 1029 - protein, 9 aa, Homo sapiens
FMDRDYHVA

SEQ ID NO: 1030 - protein, 9 aa, Homo sapiens
CETTIRVVF

SEQ ID NO: 1031 - protein, 9 aa, Homo sapiens
CETTIRVVF

SEQ ID NO: 1032 - protein, 9 aa, Homo sapiens
IMRGSKGAK

SEQ ID NO: 1033 - protein, 9 aa, Homo sapiens
VELPTEEPV

SEQ ID NO: 1034 - protein, 9 aa, Homo sapiens
SLPKDILHL

SEQ ID NO: 1035 - protein, 9 aa, Homo sapiens
VADSANYSR

SEQ ID NO: 1036 - protein, 9 aa, Homo sapiens
GTANRPLAK

SEQ ID NO: 1037 - protein, 9 aa, Homo sapiens
KTTTWLFEK

SEQ ID NO: 1038 - protein, 9 aa, Homo sapiens
FEKTPLHEF

SEQ ID NO: 1039 - protein, 9 aa, Homo sapiens
FEKTPLHEF

SEQ ID NO: 1040 - protein, 9 aa, Homo sapiens
YEIWHSDSF

SEQ ID NO: 1041 - protein, 9 aa, Homo sapiens
YEIWHSDSF

SEQ ID NO: 1042 - protein, 9 aa, Homo sapiens
KETFINGLL

SEQ ID NO: 1043 - protein, 9 aa, Homo sapiens
MEFVDVSSV

SEQ ID NO: 1044 - protein, 9 aa, Homo sapiens
MEFVDVSSV

SEQ ID NO: 1045 - protein, 9 aa, Homo sapiens
YANRNSSQL

SEQ ID NO: 1046 - protein, 9 aa, Homo sapiens
VSSIPVTRF

SEQ ID NO: 1047 - protein, 9 aa, Homo sapiens
ALSFHYLLA

SEQ ID NO: 1048 - protein, 9 aa, Homo sapiens
YLLAIFSGL

SEQ ID NO: 1049 - protein, 9 aa, Homo sapiens
DETSLGWAQ

SEQ ID NO: 1050 - protein, 9 aa, Homo sapiens
FIAENKHGL

SEQ ID NO: 1051 - protein, 9 aa, Homo sapiens
VTDSGMFQF

SEQ ID NO: 1052 - protein, 9 aa, Homo sapiens
AIGLTSFFI

SEQ ID NO: 1053 - protein, 9 aa, Homo sapiens
GLTSFFIAI

SEQ ID NO: 1054 - protein, 9 aa, Homo sapiens
FIAILVIQV

SEQ ID NO: 1055 - protein, 9 aa, Homo sapiens
GLLLILVIA

SEQ ID NO: 1056 - protein, 9 aa, Homo sapiens
LLLILVIAL

SEQ ID NO: 1057 - protein, 9 aa, Homo sapiens
LLILVIALI

SEQ ID NO: 1058 - protein, 9 aa, Homo sapiens
LILVIALIV

SEQ ID NO: 1059 - protein, 9 aa, Homo sapiens
ILYKKMGKH

SEQ ID NO: 1060 - protein, 9 aa, Homo sapiens
ALCRLTAFL

SEQ ID NO: 1061 - protein, 9 aa, Homo sapiens
SLIKKRFAI

SEQ ID NO: 1062 - protein, 9 aa, Homo sapiens
SLAYHLTKA

SEQ ID NO: 1063 - protein, 9 aa, Homo sapiens
VSLAYHLTK

SEQ ID NO: 1064 - protein, 9 aa, Homo sapiens
AIYRLVLTA

SEQ ID NO: 1065 - protein, 9 aa, Homo sapiens
REGEAIYRL

SEQ ID NO: 1066 - protein, 9 aa, Homo sapiens
GEAIYRLVL

SEQ ID NO: 1067 - protein, 9 aa, Homo sapiens
TLDREGEAI

SEQ ID NO: 1068 - protein, 9 aa, Homo sapiens
SVAYEWALK

SEQ ID NO: 1069 - protein, 9 aa, Homo sapiens
VAYEWALKK

SEQ ID NO: 1070 - protein, 9 aa, Homo sapiens
EEDSVAYEW

SEQ ID NO: 1071 - protein, 9 aa, Homo sapiens
VLEEDSVAY

SEQ ID NO: 1072 - protein, 9 aa, Homo sapiens
HLNSLEGKK

SEQ ID NO: 1073 - protein, 9 aa, Homo sapiens
SVLEYYTEL

SEQ ID NO: 1074 - protein, 9 aa, Homo sapiens
IMMPYKAAH

SEQ ID NO: 1075 - protein, 9 aa, Homo sapiens
WQDHNSLRV

SEQ ID NO: 1076 - protein, 9 aa, Homo sapiens
KEFPDLPEE

SEQ ID NO: 1077 - protein, 9 aa, Homo sapiens
KDSRIVYII

SEQ ID NO: 1078 - protein, 9 aa, Homo sapiens
SVAGCTQPL

SEQ ID NO: 1079 - protein, 9 aa, Homo sapiens
CTQPLLLAK

SEQ ID NO: 1080 - protein, 9 aa, Homo sapiens
IMNDVPSYK

SEQ ID NO: 1081 - protein, 9 aa, Homo sapiens
VLQSSKPPV

SEQ ID NO: 1082 - protein, 9 aa, Homo sapiens
LLVFLFCGL

SEQ ID NO: 1083 - protein, 9 aa, Homo sapiens
RQRKTSKSK

SEQ ID NO: 1084 - protein, 9 aa, Homo sapiens
FEAVSTWDI

SEQ ID NO: 1085 - protein, 9 aa, Homo sapiens
LADMSGLSR

SEQ ID NO: 1086 - protein, 9 aa, Homo sapiens
LLEAQEPEV

SEQ ID NO: 1087 - protein, 9 aa, Homo sapiens
RMLKGEASL

SEQ ID NO: 1088 - protein, 9 aa, Homo sapiens
TLGLRQRML

SEQ ID NO: 1089 - protein, 9 aa, Homo sapiens
TLFCVLNYT

SEQ ID NO: 1090 - protein, 9 aa, Homo sapiens
YRNNHTLFC

SEQ ID NO: 1091 - protein, 9 aa, Homo sapiens
KTLAFACQV

SEQ ID NO: 1092 - protein, 9 aa, Homo sapiens
TWMEYPKPL

SEQ ID NO: 1093 - protein, 9 aa, Homo sapiens
WQSATWMEY

SEQ ID NO: 1094 - protein, 9 aa, Homo sapiens
MEYPKPLQV

SEQ ID NO: 1095 - protein, 9 aa, Homo sapiens
VLKKKGTAE

SEQ ID NO: 1096 - protein, 9 aa, Homo sapiens
YRSGDVTRT

SEQ ID NO: 1097 - protein, 9 aa, Homo sapiens
SLYGENDQL

SEQ ID NO: 1098 - protein, 9 aa, Homo sapiens
KQVTFLLKI

SEQ ID NO: 1099 - protein, 9 aa, Homo sapiens
SLLKDPNII

SEQ ID NO: 1100 - protein, 9 aa, Homo sapiens
YHEANSNSV

SEQ ID NO: 1101 - protein, 9 aa, Homo sapiens
FFMLYLLTL

SEQ ID NO: 1102 - protein, 9 aa, Homo sapiens
FMLYLLTLM

SEQ ID NO: 1103 - protein, 9 aa, Homo sapiens
YLLTLMGNI

SEQ ID NO: 1104 - protein, 9 aa, Homo sapiens
FFMLYLLTL

SEQ ID NO: 1105 - protein, 9 aa, Homo sapiens
FFMLYLLTL

SEQ ID NO: 1106 - protein, 9 aa, Homo sapiens
KLLQTKDAL

SEQ ID NO: 1107 - protein, 9 aa, Homo sapiens
VLEGNVCYL

SEQ ID NO: 1108 - protein, 9 aa, Homo sapiens
HLAEVSAEV

SEQ ID NO: 1109 - protein, 9 aa, Homo sapiens
VSAEVKLLF

SEQ ID NO: 1110 - protein, 9 aa, Homo sapiens
MEMNLSETA

SEQ ID NO: 1111 - protein, 9 aa, Homo sapiens
MHQKIAMEM

SEQ ID NO: 1112 - protein, 9 aa, Homo sapiens
IFPGIGCPF

SEQ ID NO: 1113 - protein, 9 aa, Homo sapiens
TLSNRPVLI

SEQ ID NO: 1114 - protein, 9 aa, Homo sapiens
TLSNRPVLI

SEQ ID NO: 1115 - protein, 9 aa, Homo sapiens
THMFYSSAF

SEQ ID NO: 1116 - protein, 9 aa, Homo sapiens
THMFYSSAF

SEQ ID NO: 1117 - protein, 9 aa, Homo sapiens
RRLTKNATV

SEQ ID NO: 1118 - protein, 9 aa, Homo sapiens
IMWGRMDVA

SEQ ID NO: 1119 - protein, 9 aa, Homo sapiens
NEEQAGYPR

SEQ ID NO: 1120 - protein, 9 aa, Homo sapiens
QEIICHSEF

SEQ ID NO: 1121 - protein, 9 aa, Homo sapiens
EHKYDGHLV

SEQ ID NO: 1122 - protein, 9 aa, Homo sapiens
SFCKAGWTL

SEQ ID NO: 1123 - protein, 9 aa, Homo sapiens
TRSLIVHEI

SEQ ID NO: 1124 - protein, 9 aa, Homo sapiens
EETFVLPPA

SEQ ID NO: 1125 - protein, 9 aa, Homo sapiens
FHQVSYGEM

SEQ ID NO: 1126 - protein, 9 aa, Homo sapiens
ILVAQIFGM

SEQ ID NO: 1127 - protein, 9 aa, Homo sapiens
AQIFGMEFI

SEQ ID NO: 1128 - protein, 9 aa, Homo sapiens
QIFGMEFIL

SEQ ID NO: 1129 - protein, 9 aa, Homo sapiens
MEFILGSEE

SEQ ID NO: 1130 - protein, 9 aa, Homo sapiens
NVMGYYRFF

SEQ ID NO: 1131 - protein, 9 aa, Homo sapiens
SHHNVMGYY

SEQ ID NO: 1132 - protein, 9 aa, Homo sapiens
FYEDQRKAL

SEQ ID NO: 1133 - protein, 9 aa, Homo sapiens
NEVDEFLSR

SEQ ID NO: 1134 - protein, 9 aa, Homo sapiens
AMVSNQWHM

SEQ ID NO: 1135 - protein, 9 aa, Homo sapiens
ELMLGMFVL

SEQ ID NO: 1136 - protein, 9 aa, Homo sapiens
VAFGSGELM

SEQ ID NO: 1137 - protein, 9 aa, Homo sapiens
VLSCDSFDL

SEQ ID NO: 1138 - protein, 9 aa, Homo sapiens
ALYWEPKAL

SEQ ID NO: 1139 - protein, 9 aa, Homo sapiens
WEPKALYTL

SEQ ID NO: 1140 - protein, 9 aa, Homo sapiens
RQLPDVTCV

SEQ ID NO: 1141 - protein, 9 aa, Homo sapiens
QLPDVTCVV

SEQ ID NO: 1142 - protein, 9 aa, Homo sapiens
FTSQVEVTV

SEQ ID NO: 1143 - protein, 9 aa, Homo sapiens
SQVEVTVWA

SEQ ID NO: 1144 - protein, 9 aa, Homo sapiens
THQHFTSQV

SEQ ID NO: 1145 - protein, 9 aa, Homo sapiens
QHFTSQVEV

SEQ ID NO: 1146 - protein, 9 aa, Homo sapiens
FHPVGFHMV

SEQ ID NO: 1147 - protein, 9 aa, Homo sapiens
FHMVNILLH

SEQ ID NO: 1148 - protein, 9 aa, Homo sapiens
RLDKYRTLL

SEQ ID NO: 1149 - protein, 9 aa, Homo sapiens
MRLDKYRTL

SEQ ID NO: 1150 - protein, 9 aa, Homo sapiens
MRLDKYRTL

SEQ ID NO: 1151 - protein, 9 aa, Homo sapiens
MSKLKSWYL

SEQ ID NO: 1152 - protein, 9 aa, Homo sapiens
RYPCEWVGV

SEQ ID NO: 1153 - protein, 9 aa, Homo sapiens
MYKLKGAIM

SEQ ID NO: 1154 - protein, 9 aa, Homo sapiens
LHSHGLPLV

SEQ ID NO: 1155 - protein, 9 aa, Homo sapiens
GLISIAALT

SEQ ID NO: 1156 - protein, 9 aa, Homo sapiens
ALTVITHLV

SEQ ID NO: 1157 - protein, 9 aa, Homo sapiens
YLRLRGRCT

SEQ ID NO: 1158 - protein, 9 aa, Homo sapiens
RLRGRCTLL

SEQ ID NO: 1159 - protein, 9 aa, Homo sapiens
LRGRCTLLL

SEQ ID NO: 1160 - protein, 9 aa, Homo sapiens
IRPYFNHVI

SEQ ID NO: 1161 - protein, 9 aa, Homo sapiens
YLQALASKI

SEQ ID NO: 1162 - protein, 9 aa, Homo sapiens
KITEELEAL

SEQ ID NO: 1163 - protein, 9 aa, Homo sapiens
IRSDLGLTA

SEQ ID NO: 1164 - protein, 9 aa, Homo sapiens
QAKKGLHTL

SEQ ID NO: 1165 - protein, 9 aa, Homo sapiens
NLFETPVVA

SEQ ID NO: 1166 - protein, 9 aa, Homo sapiens
FETPVVAQY

SEQ ID NO: 1167 - protein, 9 aa, Homo sapiens
DYPRWIGAW

SEQ ID NO: 1168 - protein, 9 aa, Homo sapiens
ILNVDIFTL

SEQ ID NO: 1169 - protein, 9 aa, Homo sapiens
FHSILNVDI

SEQ ID NO: 1170 - protein, 9 aa, Homo sapiens
FMSMVGYII

SEQ ID NO: 1171 - protein, 9 aa, Homo sapiens
SYARSTAFM

SEQ ID NO: 1172 - protein, 9 aa, Homo sapiens
AFMSMVGYI

SEQ ID NO: 1173 - protein, 9 aa, Homo sapiens
QSYARSTAF

SEQ ID NO: 1174 - protein, 9 aa, Homo sapiens
HQEEFLPIF

SEQ ID NO: 1175 - protein, 9 aa, Homo sapiens
TEEKTHWEH

SEQ ID NO: 1176 - protein, 9 aa, Homo sapiens
NLSSTLEFI

SEQ ID NO: 1177 - protein, 9 aa, Homo sapiens
MRENNLSST

SEQ ID NO: 1178 - protein, 9 aa, Homo sapiens
VTVAYEHGV

SEQ ID NO: 1179 - protein, 9 aa, Homo sapiens
AEDVVTVAY

SEQ ID NO: 1180 - protein, 9 aa, Homo sapiens
DEASPLFVI

SEQ ID NO: 1181 - protein, 9 aa, Homo sapiens
WPEERKTHM

SEQ ID NO: 1182 - protein, 9 aa, Homo sapiens
SESNRGPSL

SEQ ID NO: 1183 - protein, 9 aa, Homo sapiens
KLRRRKQEA

SEQ ID NO: 1184 - protein, 9 aa, Homo sapiens
VVIMGSTPL

SEQ ID NO: 1185 - protein, 9 aa, Homo sapiens
VIMGSTPLF

SEQ ID NO: 1186 - protein, 9 aa, Homo sapiens
FLDYHDPTI

SEQ ID NO: 1187 - protein, 9 aa, Homo sapiens
FLSPGTRDA

SEQ ID NO: 1188 - protein, 9 aa, Homo sapiens
IRSWAGVCV

SEQ ID NO: 1189 - protein, 9 aa, Homo sapiens
SLHREYSGL

SEQ ID NO: 1190 - protein, 9 aa, Homo sapiens
FMSNSPLRV

SEQ ID NO: 1191 - protein, 9 aa, Homo sapiens
LAVSGLSPV

SEQ ID NO: 1192 - protein, 9 aa, Homo sapiens
GLSPVQAQA

SEQ ID NO: 1193 - protein, 9 aa, Homo sapiens
WLDVIVTAA

SEQ ID NO: 1194 - protein, 9 aa, Homo sapiens
SLRNRKMEG

SEQ ID NO: 1195 - protein, 9 aa, Homo sapiens
VLIGTPVVI

SEQ ID NO: 1196 - protein, 9 aa, Homo sapiens
LLDALSGRL

SEQ ID NO: 1197 - protein, 9 aa, Homo sapiens
LPGLYYNGL

SEQ ID NO: 1198 - protein, 9 aa, Homo sapiens
GRMKLTVNL

SEQ ID NO: 1199 - protein, 9 aa, Homo sapiens
GMSGRWVLV

SEQ ID NO: 1200 - protein, 9 aa, Homo sapiens
WILFLPMEL

SEQ ID NO: 1201 - protein, 9 aa, Homo sapiens
MELGDSGVY

SEQ ID NO: 1202 - protein, 9 aa, Homo sapiens
VQIPYEVTI

SEQ ID NO: 1203 - protein, 9 aa, Homo sapiens
TIWILLASL

SEQ ID NO: 1204 - protein, 9 aa, Homo sapiens
YEVTIWILL

SEQ ID NO: 1205 - protein, 9 aa, Homo sapiens
TRWKKKGQM

SEQ ID NO: 1206 - protein, 9 aa, Homo sapiens
SHREVAQFC

SEQ ID NO: 1207 - protein, 9 aa, Homo sapiens
LESKRDILF

SEQ ID NO: 1208 - protein, 9 aa, Homo sapiens
SRSEAVRWL

SEQ ID NO: 1209 - protein, 9 aa, Homo sapiens
DEEELSRTK

SEQ ID NO: 1210 - protein, 9 aa, Homo sapiens
ALGASCCEI

SEQ ID NO: 1211 - protein, 9 aa, Homo sapiens
EPRPHEPPV

SEQ ID NO: 1212 - protein, 9 aa, Homo sapiens
SLSETRHPM

SEQ ID NO: 1213 - protein, 9 aa, Homo sapiens
LLFAAFSSA

SEQ ID NO: 1214 - protein, 9 aa, Homo sapiens
SREVAHGEL

SEQ ID NO: 1215 - protein, 9 aa, Homo sapiens
YQGDGMVCL

SEQ ID NO: 1216 - protein, 9 aa, Homo sapiens
SALQGVTSV

SEQ ID NO: 1217 - protein, 9 aa, Homo sapiens
YQGLWHSCV

SEQ ID NO: 1218 - protein, 9 aa, Homo sapiens
MLLKHDVSL

SEQ ID NO: 1219 - protein, 9 aa, Homo sapiens
MLLKHDVSL

SEQ ID NO: 1220 - protein, 9 aa, Homo sapiens
LHEEPPQAY

SEQ ID NO: 1221 - protein, 9 aa, Homo sapiens
FMRNRESQS

SEQ ID NO: 1222 - protein, 9 aa, Homo sapiens
MRNRESQSV

SEQ ID NO: 1223 - protein, 9 aa, Homo sapiens
MFARKHESL

SEQ ID NO: 1224 - protein, 9 aa, Homo sapiens
FARKHESLL

SEQ ID NO: 1225 - protein, 9 aa, Homo sapiens
HESLLLVTK

SEQ ID NO: 1226 - protein, 9 aa, Homo sapiens
FARKHESLL

SEQ ID NO: 1227 - protein, 9 aa, Homo sapiens
ARKHESLLL

SEQ ID NO: 1228 - protein, 9 aa, Homo sapiens
GIHDGIQRV

SEQ ID NO: 1229 - protein, 9 aa, Homo sapiens
IHDGIQRVL

SEQ ID NO: 1230 - protein, 9 aa, Homo sapiens
ILLKHKYCF

SEQ ID NO: 1231 - protein, 9 aa, Homo sapiens
ILLKHKYCF

SEQ ID NO: 1232 - protein, 9 aa, Homo sapiens
LLKHKYCFL

SEQ ID NO: 1233 - protein, 9 aa, Homo sapiens
ALMAILLCI

SEQ ID NO: 1234 - protein, 9 aa, Homo sapiens
LMAILLCII

SEQ ID NO: 1235 - protein, 9 aa, Homo sapiens
LELDEHYWV

SEQ ID NO: 1236 - protein, 9 aa, Homo sapiens
ARLDGILEL

SEQ ID NO: 1237 - protein, 9 aa, Homo sapiens
SQILVYFSV

SEQ ID NO: 1238 - protein, 9 aa, Homo sapiens
DESQILVYF

SEQ ID NO: 1239 - protein, 9 aa, Homo sapiens
YRCDCNEGF

SEQ ID NO: 1240 - protein, 9 aa, Homo sapiens
ALLSTVIAL

SEQ ID NO: 1241 - protein, 9 aa, Homo sapiens
LLSTVIALI

SEQ ID NO: 1242 - protein, 9 aa, Homo sapiens
SRPNLLKNM

SEQ ID NO: 1243 - protein, 9 aa, Homo sapiens
RSYRQRQEV

SEQ ID NO: 1244 - protein, 9 aa, Homo sapiens
VLATFDPAL

SEQ ID NO: 1245 - protein, 9 aa, Homo sapiens
DGLQRSHIL

SEQ ID NO: 1246 - protein, 9 aa, Homo sapiens
TEKICLDFY

SEQ ID NO: 1247 - protein, 9 aa, Homo sapiens
KLHTPGNYL

SEQ ID NO: 1248 - protein, 9 aa, Homo sapiens
LHTPGNYLI

SEQ ID NO: 1249 - protein, 9 aa, Homo sapiens
KIQRALWLL

SEQ ID NO: 1250 - protein, 9 aa, Homo sapiens
IYAFRNQKI

SEQ ID NO: 1251 - protein, 9 aa, Homo sapiens
KIQRALWLL

SEQ ID NO: 1252 - protein, 9 aa, Homo sapiens
FRNQKIQRA

SEQ ID NO: 1253 - protein, 9 aa, Homo sapiens
TLSRRIEDL

SEQ ID NO: 1254 - protein, 9 aa, Homo sapiens
TNVCRYASL

SEQ ID NO: 1255 - protein, 9 aa, Homo sapiens
CRYASLMAM

SEQ ID NO: 1256 - protein, 9 aa, Homo sapiens
SMGYCIGWL

SEQ ID NO: 1257 - protein, 9 aa, Homo sapiens
HYFSMGYCI

SEQ ID NO: 1258 - protein, 9 aa, Homo sapiens
FAASNIVAV

SEQ ID NO: 1259 - protein, 9 aa, Homo sapiens
IVAVVACLV

SEQ ID NO: 1260 - protein, 9 aa, Homo sapiens
SRPKKREGI

SEQ ID NO: 1261 - protein, 9 aa, Homo sapiens
IHLPTTKEL

SEQ ID NO: 1262 - protein, 9 aa, Homo sapiens
STLVTTILV

SEQ ID NO: 1263 - protein, 9 aa, Homo sapiens
MEISTLVTT

SEQ ID NO: 1264 - protein, 9 aa, Homo sapiens
ILLHCAVGV

SEQ ID NO: 1265 - protein, 9 aa, Homo sapiens
AVLCGSASI

SEQ ID NO: 1266 - protein, 9 aa, Homo sapiens
LLAILTYYV

SEQ ID NO: 1267 - protein, 9 aa, Homo sapiens
AILTYYVTI

SEQ ID NO: 1268 - protein, 9 aa, Homo sapiens
LTYYVTIFL

SEQ ID NO: 1269 - protein, 9 aa, Homo sapiens
IDLLAILTY

SEQ ID NO: 1270 - protein, 9 aa, Homo sapiens
LRYGHDFSI

SEQ ID NO: 1271 - protein, 9 aa, Homo sapiens
SIKKKWQTF

SEQ ID NO: 1272 - protein, 9 aa, Homo sapiens
SIKKKWQTF

SEQ ID NO: 1273 - protein, 9 aa, Homo sapiens
SEVAFDHSF

SEQ ID NO: 1274 - protein, 9 aa, Homo sapiens
SESAFDHSF

SEQ ID NO: 1275 - protein, 9 aa, Homo sapiens
TLRREFSDA

SEQ ID NO: 1276 - protein, 9 aa, Homo sapiens
VELVPNITY

SEQ ID NO: 1277 - protein, 9 aa, Homo sapiens
SLKHKLSQA

SEQ ID NO: 1278 - protein, 9 aa, Homo sapiens
AVDKLLAGV

SEQ ID NO: 1279 - protein, 9 aa, Homo sapiens
KLLAGVEIV

SEQ ID NO: 1280 - protein, 9 aa, Homo sapiens
NFKRRQKCF

SEQ ID NO: 1281 - protein, 9 aa, Homo sapiens
LTLRLVPYL

SEQ ID NO: 1282 - protein, 9 aa, Homo sapiens
RLVPYLEFL

SEQ ID NO: 1283 - protein, 9 aa, Homo sapiens
LVPYLEFLV

SEQ ID NO: 1284 - protein, 9 aa, Homo sapiens
HHTDLANIF

SEQ ID NO: 1285 - protein, 9 aa, Homo sapiens
THPTKPPSF

SEQ ID NO: 1286 - protein, 9 aa, Homo sapiens
FVWGPRACL

SEQ ID NO: 1287 - protein, 9 aa, Homo sapiens
SRSRRAVSV

SEQ ID NO: 1288 - protein, 9 aa, Homo sapiens
SRSRRAVSV

SEQ ID NO: 1289 - protein, 9 aa, Homo sapiens
FLLYKIVSG

SEQ ID NO: 1290 - protein, 9 aa, Homo sapiens
VRINYKLSI

SEQ ID NO: 1291 - protein, 9 aa, Homo sapiens
RHGGDPGLV

SEQ ID NO: 1292 - protein, 9 aa, Homo sapiens
YLQEKLWAS

SEQ ID NO: 1293 - protein, 9 aa, Homo sapiens
KLWASPLHV

SEQ ID NO: 1294 - protein, 9 aa, Homo sapiens
RSRYHLQLR

SEQ ID NO: 1295 - protein, 9 aa, Homo sapiens
PRSRYHLQL

SEQ ID NO: 1296 - protein, 9 aa, Homo sapiens
YHLQLRARL

SEQ ID NO: 1297 - protein, 9 aa, Homo sapiens
LLDEKGPEV

SEQ ID NO: 1298 - protein, 9 aa, Homo sapiens
LLDEKGPEV

SEQ ID NO: 1299 - protein, 9 aa, Homo sapiens
VVLQCIATI

SEQ ID NO: 1300 - protein, 9 aa, Homo sapiens
LLLIFNVSV

SEQ ID NO: 1301 - protein, 9 aa, Homo sapiens
LIFNVSVNL

SEQ ID NO: 1302 - protein, 9 aa, Homo sapiens
GMQDFLFKA

SEQ ID NO: 1303 - protein, 9 aa, Homo sapiens
VLSQKATEV

SEQ ID NO: 1304 - protein, 9 aa, Homo sapiens
VTVTWSATR

SEQ ID NO: 1305 - protein, 9 aa, Homo sapiens
TWSATRRRR

SEQ ID NO: 1306 - protein, 9 aa, Homo sapiens
SRHKAEALL

SEQ ID NO: 1307 - protein, 9 aa, Homo sapiens
ERTQAAMYL

SEQ ID NO: 1308 - protein, 9 aa, Homo sapiens
RPLGRLWNR

SEQ ID NO: 1309 - protein, 9 aa, Homo sapiens
HSVAGLLPR

SEQ ID NO: 1310 - protein, 9 aa, Homo sapiens
GLAWCCYLL

SEQ ID NO: 1311 - protein, 9 aa, Homo sapiens
GIMAEAPRV

SEQ ID NO: 1312 - protein, 9 aa, Homo sapiens
RLLVAALSA

SEQ ID NO: 1313 - protein, 9 aa, Homo sapiens
LVAALSAGI

SEQ ID NO: 1314 - protein, 9 aa, Homo sapiens
QHHHHHHHL

SEQ ID NO: 1315 - protein, 9 aa, Homo sapiens
TVLFCLLFL

SEQ ID NO: 1316 - protein, 9 aa, Homo sapiens
LIDGTTAYV

SEQ ID NO: 1317 - protein, 9 aa, Homo sapiens
LIDGTTAYV

SEQ ID NO: 1318 - protein, 9 aa, Homo sapiens
ATASTAVPV

SEQ ID NO: 1319 - protein, 9 aa, Homo sapiens
LLAHFAASA

SEQ ID NO: 1320 - protein, 9 aa, Homo sapiens
DLYSSALKR

SEQ ID NO: 1321 - protein, 9 aa, Homo sapiens
SHSSHHQEA

SEQ ID NO: 1322 - protein, 9 aa, Homo sapiens
VSHKPLNYR

SEQ ID NO: 1323 - protein, 9 aa, Homo sapiens
KLTQLRIHV

SEQ ID NO: 1324 - protein, 9 aa, Homo sapiens
QPVANTTAA

SEQ ID NO: 1325 - protein, 9 aa, Homo sapiens
LAVARDAPA

SEQ ID NO: 1326 - protein, 9 aa, Homo sapiens
MAAATASTR

SEQ ID NO: 1327 - protein, 9 aa, Homo sapiens
HPWDPGSPV

SEQ ID NO: 1328 - protein, 9 aa, Homo sapiens
HPWDPGSPW

SEQ ID NO: 1329 - protein, 9 aa, Homo sapiens
RRRGRLWDL

SEQ ID NO: 1330 - protein, 9 aa, Homo sapiens
AVVKMLPPF

SEQ ID NO: 1331 - protein, 9 aa, Homo sapiens
RRFTSCDML

SEQ ID NO: 1332 - protein, 9 aa, Homo sapiens
SINDNWIRY

SEQ ID NO: 1333 - protein, 9 aa, Homo sapiens
SINDNWIRY

SEQ ID NO: 1334 - protein, 9 aa, Homo sapiens
FPNSSKWTS

SEQ ID NO: 1335 - protein, 9 aa, Homo sapiens
LAATLLPVL

SEQ ID NO: 1336 - protein, 9 aa, Homo sapiens
LPVLLLSLL

SEQ ID NO: 1337 - protein, 9 aa, Homo sapiens
LADPSLPPY

SEQ ID NO: 1338 - protein, 9 aa, Homo sapiens
LADPSLPPY

SEQ ID NO: 1339 - protein, 9 aa, Homo sapiens
LPPYVCTSL

SEQ ID NO: 1340 - protein, 9 aa, Homo sapiens
FAREAQRAL

SEQ ID NO: 1341 - protein, 9 aa, Homo sapiens
FAREAQRAL

SEQ ID NO: 1342 - protein, 9 aa, Homo sapiens
LALLLASAL

SEQ ID NO: 1343 - protein, 9 aa, Homo sapiens
DRRPSSTSV

SEQ ID NO: 1344 - protein, 9 aa, Homo sapiens
LPRPVYLFF

SEQ ID NO: 1345 - protein, 9 aa, Homo sapiens
ERLPRPVYL

SEQ ID NO: 1346 - protein, 9 aa, Homo sapiens
SSNHRVDLY

SEQ ID NO: 1347 - protein, 9 aa, Homo sapiens
VPIRDIPAF

SEQ ID NO: 1348 - protein, 9 aa, Homo sapiens
TRNVPIRDI

SEQ ID NO: 1349 - protein, 9 aa, Homo sapiens
TPFSLMIAC

SEQ ID NO: 1350 - protein, 9 aa, Homo sapiens
KPSSTCCPF

SEQ ID NO: 1351 - protein, 9 aa, Homo sapiens
CPFRTLDTM

SEQ ID NO: 1352 - protein, 9 aa, Homo sapiens
QAASPMHLF

SEQ ID NO: 1353 - protein, 9 aa, Homo sapiens
FRHQRIYTG

SEQ ID NO: 1354 - protein, 9 aa, Homo sapiens
MVFEDVPIH

SEQ ID NO: 1355 - protein, 9 aa, Homo sapiens
RHFKQRRSF

SEQ ID NO: 1356 - protein, 9 aa, Homo sapiens
VHTLNVLVL

SEQ ID NO: 1357 - protein, 9 aa, Homo sapiens
ESMGITEAF

SEQ ID NO: 1358 - protein, 9 aa, Homo sapiens
ESMGITEAF

SEQ ID NO: 1359 - protein, 9 aa, Homo sapiens
YSIMRGNEM

SEQ ID NO: 1360 - protein, 9 aa, Homo sapiens
MRGNEMNLF

SEQ ID NO: 1361 - protein, 9 aa, Homo sapiens
FPSFQSNAA

SEQ ID NO: 1362 - protein, 9 aa, Homo sapiens
SFQSNAAAY

SEQ ID NO: 1363 - protein, 9 aa, Homo sapiens
ERSKKSVEI

SEQ ID NO: 1364 - protein, 9 aa, Homo sapiens
MTRDDAGNY

SEQ ID NO: 1365 - protein, 9 aa, Homo sapiens
QLIEIMCNY

SEQ ID NO: 1366 - protein, 9 aa, Homo sapiens
VHQRNPLSL

SEQ ID NO: 1367 - protein, 9 aa, Homo sapiens
HPDAAEILQ

SEQ ID NO: 1368 - protein, 9 aa, Homo sapiens
FTYYPNTVF

SEQ ID NO: 1369 - protein, 9 aa, Homo sapiens
YPNTVFEAF

SEQ ID NO: 1370 - protein, 9 aa, Homo sapiens
YPPRCLPPY

SEQ ID NO: 1371 - protein, 9 aa, Homo sapiens
NDMGSIPEY

SEQ ID NO: 1372 - protein, 9 aa, Homo sapiens
LADADYSEL

SEQ ID NO: 1373 - protein, 9 aa, Homo sapiens
FPQVGRMAL

SEQ ID NO: 1374 - protein, 9 aa, Homo sapiens
YNFPQVGRM

SEQ ID NO: 1375 - protein, 9 aa, Homo sapiens
MAEHFQEAM

SEQ ID NO: 1376 - protein, 9 aa, Homo sapiens
DSSRKPRAI

SEQ ID NO: 1377 - protein, 9 aa, Homo sapiens
SSLHFMVEL

SEQ ID NO: 1378 - protein, 9 aa, Homo sapiens
SSLHFMVEL

SEQ ID NO: 1379 - protein, 9 aa, Homo sapiens
SHSAASPLF

SEQ ID NO: 1380 - protein, 9 aa, Homo sapiens
LLSGLLYPV

SEQ ID NO: 1381 - protein, 9 aa, Homo sapiens
LLYPVLQAL

SEQ ID NO: 1382 - protein, 9 aa, Homo sapiens
CYRLVGHSM

SEQ ID NO: 1383 - protein, 9 aa, Homo sapiens
YFKEAVDRW

SEQ ID NO: 1384 - protein, 9 aa, Homo sapiens
EAVDRWAQF

SEQ ID NO: 1385 - protein, 9 aa, Homo sapiens
VNLEAPEPV

SEQ ID NO: 1386 - protein, 9 aa, Homo sapiens
EAPEPVVEV

SEQ ID NO: 1387 - protein, 9 aa, Homo sapiens
APEPVVEVI

SEQ ID NO: 1388 - protein, 9 aa, Homo sapiens
ILDLHISTL

SEQ ID NO: 1389 - protein, 9 aa, Homo sapiens
KLNHVAARL

SEQ ID NO: 1390 - protein, 9 aa, Homo sapiens
MAFPITMLL

SEQ ID NO: 1391 - protein, 9 aa, Homo sapiens
GSVSMAFPI

SEQ ID NO: 1392 - protein, 9 aa, Homo sapiens
MAFPITMLL

SEQ ID NO: 1393 - protein, 9 aa, Homo sapiens
VSMAFPITM

SEQ ID NO: 1394 - protein, 9 aa, Homo sapiens
MAFPITMLL

SEQ ID NO: 1395 - protein, 9 aa, Homo sapiens
FYAMCVETI

SEQ ID NO: 1396 - protein, 9 aa, Homo sapiens
LIAHGFFSF

SEQ ID NO: 1397 - protein, 9 aa, Homo sapiens
IAHGFFSFY

SEQ ID NO: 1398 - protein, 9 aa, Homo sapiens
FYAMCVETI

SEQ ID NO: 1399 - protein, 9 aa, Homo sapiens
IVLEYLDHL

SEQ ID NO: 1400 - protein, 9 aa, Homo sapiens
MYSDEKPTL

SEQ ID NO: 1401 - protein, 9 aa, Homo sapiens
YSDEKPTLV

SEQ ID NO: 1402 - protein, 9 aa, Homo sapiens
YYDVVINPM

SEQ ID NO: 1403 - protein, 9 aa, Homo sapiens
LHNYYDVVI

SEQ ID NO: 1404 - protein, 9 aa, Homo sapiens
YYDVVINPM

SEQ ID NO: 1405 - protein, 9 aa, Homo sapiens
ILSQFMHTL

SEQ ID NO: 1406 - protein, 9 aa, Homo sapiens
ILSQFMHTL

SEQ ID NO: 1407 - protein, 9 aa, Homo sapiens
KCIDHPNVY

SEQ ID NO: 1408 - protein, 9 aa, Homo sapiens
QTLESRPSV

SEQ ID NO: 1409 - protein, 9 aa, Homo sapiens
LLSRWLRSV

SEQ ID NO: 1410 - protein, 9 aa, Homo sapiens
MIYPPRAAV

SEQ ID NO: 1411 - protein, 9 aa, Homo sapiens
QWNRTLKPL

SEQ ID NO: 1412 - protein, 9 aa, Homo sapiens
SKYDTLMII

SEQ ID NO: 1413 - protein, 9 aa, Homo sapiens
DTLMIIKHL

SEQ ID NO: 1414 - protein, 9 aa, Homo sapiens
MPRRNKGMM

SEQ ID NO: 1415 - protein, 9 aa, Homo sapiens
RQCHSAVVI

SEQ ID NO: 1416 - protein, 9 aa, Homo sapiens
YIRQCHSAV

SEQ ID NO: 1417 - protein, 9 aa, Homo sapiens
RQCHSAVVI

SEQ ID NO: 1418 - protein, 9 aa, Homo sapiens
RQLHSAVVI

SEQ ID NO: 1419 - protein, 9 aa, Homo sapiens
YIRQLHSAV

SEQ ID NO: 1420 - protein, 9 aa, Homo sapiens
RQLHSAVVI

SEQ ID NO: 1421 - protein, 9 aa, Homo sapiens
KPVPPQGPM

SEQ ID NO: 1422 - protein, 9 aa, Homo sapiens
CQYEFQVTA

SEQ ID NO: 1423 - protein, 9 aa, Homo sapiens
YEFQVTAVA

SEQ ID NO: 1424 - protein, 9 aa, Homo sapiens
KLMLQFHTL

SEQ ID NO: 1425 - protein, 9 aa, Homo sapiens
LMLQFHTLL

SEQ ID NO: 1426 - protein, 9 aa, Homo sapiens
LMLQFHTLL

SEQ ID NO: 1427 - protein, 9 aa, Homo sapiens
VTFLEATRF

SEQ ID NO: 1428 - protein, 9 aa, Homo sapiens
REYSRYLHV

SEQ ID NO: 1429 - protein, 9 aa, Homo sapiens
YSRYLHVHL

SEQ ID NO: 1430 - protein, 9 aa, Homo sapiens
QALNMSSAL

SEQ ID NO: 1431 - protein, 9 aa, Homo sapiens
YFQPFLGSI

SEQ ID NO: 1432 - protein, 9 aa, Homo sapiens
YFQPFLGSI

SEQ ID NO: 1433 - protein, 9 aa, Homo sapiens
QPFLGSIEI

SEQ ID NO: 1434 - protein, 9 aa, Homo sapiens
RLCRCLVSV

SEQ ID NO: 1435 - protein, 9 aa, Homo sapiens
RLCRCLVSV

SEQ ID NO: 1436 - protein, 9 aa, Homo sapiens
KICGLIATF

SEQ ID NO: 1437 - protein, 9 aa, Homo sapiens
HFFCEARVL

SEQ ID NO: 1438 - protein, 9 aa, Homo sapiens
FFCEARVLV

SEQ ID NO: 1439 - protein, 9 aa, Homo sapiens
IQMFFHLTM

SEQ ID NO: 1440 - protein, 9 aa, Homo sapiens
LTMAGAEVF

SEQ ID NO: 1441 - protein, 9 aa, Homo sapiens
IQMFFHLTM

SEQ ID NO: 1442 - protein, 9 aa, Homo sapiens
LTMAGAEVF

SEQ ID NO: 1443 - protein, 9 aa, Homo sapiens
SNYSVYAYF

SEQ ID NO: 1444 - protein, 9 aa, Homo sapiens
NYSVYAYFI

SEQ ID NO: 1445 - protein, 9 aa, Homo sapiens
AYFILLGLF

SEQ ID NO: 1446 - protein, 9 aa, Homo sapiens
QSNYSVYAY

SEQ ID NO: 1447 - protein, 9 aa, Homo sapiens
YSVYAYFIL

SEQ ID NO: 1448 - protein, 9 aa, Homo sapiens
SVYAYFILL

SEQ ID NO: 1449 - protein, 9 aa, Homo sapiens
YAYFILLGL

SEQ ID NO: 1450 - protein, 9 aa, Homo sapiens
RYQLQLGVV

SEQ ID NO: 1451 - protein, 9 aa, Homo sapiens
IALRYQLQL

SEQ ID NO: 1452 - protein, 9 aa, Homo sapiens
YQLQLGVVV

SEQ ID NO: 1453 - protein, 9 aa, Homo sapiens
GTHLVSEVF

SEQ ID NO: 1454 - protein, 9 aa, Homo sapiens
EAGQTGRII

SEQ ID NO: 1455 - protein, 9 aa, Homo sapiens
EVVDDITSI

SEQ ID NO: 1456 - protein, 9 aa, Homo sapiens
FTSYSAVSI

SEQ ID NO: 1457 - protein, 9 aa, Homo sapiens
FDFTSYSAV

SEQ ID NO: 1458 - protein, 9 aa, Homo sapiens
FTSYSAVSI

SEQ ID NO: 1459 - protein, 9 aa, Homo sapiens
QYTHVNKVW

SEQ ID NO: 1460 - protein, 9 aa, Homo sapiens
PQYTHVNKV

SEQ ID NO: 1461 - protein, 9 aa, Homo sapiens
SYTANHAAF

SEQ ID NO: 1462 - protein, 9 aa, Homo sapiens
YTANHAAFL

SEQ ID NO: 1463 - protein, 9 aa, Homo sapiens
TASSLVCPL

SEQ ID NO: 1464 - protein, 9 aa, Homo sapiens
LVCPLPAHL

SEQ ID NO: 1465 - protein, 9 aa, Homo sapiens
DMRPFFKEY

SEQ ID NO: 1466 - protein, 9 aa, Homo sapiens
VSYVNLSSI

SEQ ID NO: 1467 - protein, 9 aa, Homo sapiens
SIEDGIKHV

SEQ ID NO: 1468 - protein, 9 aa, Homo sapiens
SKEDGIKHV

SEQ ID NO: 1469 - protein, 9 aa, Homo sapiens
GLLQEMVFF

SEQ ID NO: 1470 - protein, 9 aa, Homo sapiens
ISFPYGPCL

SEQ ID NO: 1471 - protein, 9 aa, Homo sapiens
FPYGPCLEW

SEQ ID NO: 1472 - protein, 9 aa, Homo sapiens
RHYTAINFI

SEQ ID NO: 1473 - protein, 9 aa, Homo sapiens
RHYTAINFI

SEQ ID NO: 1474 - protein, 9 aa, Homo sapiens
LIVMHGSLV

SEQ ID NO: 1475 - protein, 9 aa, Homo sapiens
LLADCQIHL

SEQ ID NO: 1476 - protein, 9 aa, Homo sapiens
RHFLNLAPI

SEQ ID NO: 1477 - protein, 9 aa, Homo sapiens
RHFLNLAPI

SEQ ID NO: 1478 - protein, 9 aa, Homo sapiens
FLNLAPIKI

SEQ ID NO: 1479 - protein, 9 aa, Homo sapiens
FDRKPISII

SEQ ID NO: 1480 - protein, 9 aa, Homo sapiens
VYTNSSNTF

SEQ ID NO: 1481 - protein, 9 aa, Homo sapiens
FYWELNQAV

SEQ ID NO: 1482 - protein, 9 aa, Homo sapiens
YTNSSNTFY

SEQ ID NO: 1483 - protein, 9 aa, Homo sapiens
FYWELNQAV

SEQ ID NO: 1484 - protein, 9 aa, Homo sapiens
YENKSLEEL

SEQ ID NO: 1485 - protein, 9 aa, Homo sapiens
LLHEPMYYF

SEQ ID NO: 1486 - protein, 9 aa, Homo sapiens
LARNFCKEF

SEQ ID NO: 1487 - protein, 9 aa, Homo sapiens
FCKEFTPQM

SEQ ID NO: 1488 - protein, 9 aa, Homo sapiens
FYGTDSMTY

SEQ ID NO: 1489 - protein, 9 aa, Homo sapiens
YGTDSMTYL

SEQ ID NO: 1490 - protein, 9 aa, Homo sapiens
QASSCQARM

SEQ ID NO: 1491 - protein, 9 aa, Homo sapiens
GYLEVIGFI

SEQ ID NO: 1492 - protein, 9 aa, Homo sapiens
FIMTSLAAL

SEQ ID NO: 1493 - protein, 9 aa, Homo sapiens
EARSGLQQL

SEQ ID NO: 1494 - protein, 9 aa, Homo sapiens
AFGVGNNYW

SEQ ID NO: 1495 - protein, 9 aa, Homo sapiens
WAFGVGNNY

SEQ ID NO: 1496 - protein, 9 aa, Homo sapiens
SYFCILITL

SEQ ID NO: 1497 - protein, 9 aa, Homo sapiens
YFCILITLL

SEQ ID NO: 1498 - protein, 9 aa, Homo sapiens
LQIHTPMYF

SEQ ID NO: 1499 - protein, 9 aa, Homo sapiens
QIHTPMYFF

SEQ ID NO: 1500 - protein, 9 aa, Homo sapiens
IHTPMYFFL

SEQ ID NO: 1501 - protein, 9 aa, Homo sapiens
YSLPNTDVI

SEQ ID NO: 1502 - protein, 9 aa, Homo sapiens
YSLPNTDVI

SEQ ID NO: 1503 - protein, 9 aa, Homo sapiens
VKSPFKKVV

SEQ ID NO: 1504 - protein, 9 aa, Homo sapiens
VFAPYPSHI

SEQ ID NO: 1505 - protein, 9 aa, Homo sapiens
YPSHINPAI

SEQ ID NO: 1506 - protein, 9 aa, Homo sapiens
ELLTGALPF

SEQ ID NO: 1507 - protein, 9 aa, Homo sapiens
FMHEEACVV

SEQ ID NO: 1508 - protein, 9 aa, Homo sapiens
KMYHINETC

SEQ ID NO: 1509 - protein, 9 aa, Homo sapiens
YHINETCGL

SEQ ID NO: 1510 - protein, 9 aa, Homo sapiens
QVAQELLEF

SEQ ID NO: 1511 - protein, 9 aa, Homo sapiens
FSVHHQPTM

SEQ ID NO: 1512 - protein, 9 aa, Homo sapiens
KINPKTEGI

SEQ ID NO: 1513 - protein, 9 aa, Homo sapiens
KTEGISVSE

SEQ ID NO: 1514 - protein, 9 aa, Homo sapiens
PYFLVKESL

SEQ ID NO: 1515 - protein, 9 aa, Homo sapiens
LQDSAMNLV

SEQ ID NO: 1516 - protein, 9 aa, Homo sapiens
RPLGPSPLV

SEQ ID NO: 1517 - protein, 9 aa, Homo sapiens
QAFSLNETC

SEQ ID NO: 1518 - protein, 9 aa, Homo sapiens
QPRDMVAVL

SEQ ID NO: 1519 - protein, 9 aa, Homo sapiens
TYKCFTEAV

SEQ ID NO: 1520 - protein, 9 aa, Homo sapiens
AATRQCNTV

SEQ ID NO: 1521 - protein, 9 aa, Homo sapiens
DAFCWAVVS

SEQ ID NO: 1522 - protein, 9 aa, Homo sapiens
VPMKLDVSI

SEQ ID NO: 1523 - protein, 9 aa, Homo sapiens
KDSQMNSPF

SEQ ID NO: 1524 - protein, 9 aa, Homo sapiens
CQYVGANVL

SEQ ID NO: 1525 - protein, 9 aa, Homo sapiens
YVGANVLDL

SEQ ID NO: 1526 - protein, 9 aa, Homo sapiens
NVLDLAETM

SEQ ID NO: 1527 - protein, 9 aa, Homo sapiens
IHAKRVTII

SEQ ID NO: 1528 - protein, 9 aa, Homo sapiens
SQLPGIPKM

SEQ ID NO: 1529 - protein, 9 aa, Homo sapiens
KVEEFPIRY

SEQ ID NO: 1530 - protein, 9 aa, Homo sapiens
FPIRYEDEI

SEQ ID NO: 1531 - protein, 9 aa, Homo sapiens
RLQEITHSV

SEQ ID NO: 1532 - protein, 9 aa, Homo sapiens
ITHSVRIGF

SEQ ID NO: 1533 - protein, 9 aa, Homo sapiens
RLQEITHSV

SEQ ID NO: 1534 - protein, 9 aa, Homo sapiens
FSSHCPFLI

SEQ ID NO: 1535 - protein, 9 aa, Homo sapiens
FLIGPIECL

SEQ ID NO: 1536 - protein, 9 aa, Homo sapiens
SWVTGFLFI

SEQ ID NO: 1537 - protein, 9 aa, Homo sapiens
WVTGFLFIF

SEQ ID NO: 1538 - protein, 9 aa, Homo sapiens
GFLFIFPPL

SEQ ID NO: 1539 - protein, 9 aa, Homo sapiens
SSWVTGFLF

SEQ ID NO: 1540 - protein, 9 aa, Homo sapiens
FLFIFPPLV

SEQ ID NO: 1541 - protein, 9 aa, Homo sapiens
FIFPPLVMG

SEQ ID NO: 1542 - protein, 9 aa, Homo sapiens
IRFRTGPIV

SEQ ID NO: 1543 - protein, 9 aa, Homo sapiens
RTGPIVPSV

SEQ ID NO: 1544 - protein, 9 aa, Homo sapiens
EATARELPI

SEQ ID NO: 1545 - protein, 9 aa, Homo sapiens
YHKDHFTKL

SEQ ID NO: 1546 - protein, 9 aa, Homo sapiens
RMRSLIVSW

SEQ ID NO: 1547 - protein, 9 aa, Homo sapiens
LRFISPEVI

SEQ ID NO: 1548 - protein, 9 aa, Homo sapiens
YIAGGGGTW

SEQ ID NO: 1549 - protein, 9 aa, Homo sapiens
RYGLVITEA

SEQ ID NO: 1550 - protein, 9 aa, Homo sapiens
ATQRYGLVI

SEQ ID NO: 1551 - protein, 9 aa, Homo sapiens
LTLANWERI

SEQ ID NO: 1552 - protein, 9 aa, Homo sapiens
SYDPARYPW

SEQ ID NO: 1553 - protein, 9 aa, Homo sapiens
RYPWYLPEA

SEQ ID NO: 1554 - protein, 9 aa, Homo sapiens
WYLPEAYCL

SEQ ID NO: 1555 - protein, 9 aa, Homo sapiens
YPWYLPEAY

SEQ ID NO: 1556 - protein, 9 aa, Homo sapiens
SSLTITDAF

SEQ ID NO: 1557 - protein, 9 aa, Homo sapiens
AFHEEMKIF

SEQ ID NO: 1558 - protein, 9 aa, Homo sapiens
KAFHEEMKI

SEQ ID NO: 1559 - protein, 9 aa, Homo sapiens
HVLNAWCAF

SEQ ID NO: 1560 - protein, 9 aa, Homo sapiens
HVLNAWCAF

SEQ ID NO: 1561 - protein, 9 aa, Homo sapiens
QEHPSVRTL

SEQ ID NO: 1562 - protein, 9 aa, Homo sapiens
LVIGTSLHV

SEQ ID NO: 1563 - protein, 9 aa, Homo sapiens
HAQEKYEQF

SEQ ID NO: 1564 - protein, 9 aa, Homo sapiens
KYEQFESVL

SEQ ID NO: 1565 - protein, 9 aa, Homo sapiens
HAQEKYEQF

SEQ ID NO: 1566 - protein, 9 aa, Homo sapiens
EKYEQFESV

SEQ ID NO: 1567 - protein, 9 aa, Homo sapiens
FIGRWELQI

SEQ ID NO: 1568 - protein, 9 aa, Homo sapiens
FVQQHRLVL

SEQ ID NO: 1569 - protein, 9 aa, Homo sapiens
HSAPGDLIY

SEQ ID NO: 1570 - protein, 9 aa, Homo sapiens
SLMQLESPW

SEQ ID NO: 1571 - protein, 9 aa, Homo sapiens
LESPWRQHF

SEQ ID NO: 1572 - protein, 9 aa, Homo sapiens
YVEAAHESL

SEQ ID NO: 1573 - protein, 9 aa, Homo sapiens
EAAHESLVV

SEQ ID NO: 1574 - protein, 9 aa, Homo sapiens
AAHESLVVF

SEQ ID NO: 1575 - protein, 9 aa, Homo sapiens
YYLKTVVHL

SEQ ID NO: 1576 - protein, 9 aa, Homo sapiens
YYLKTVVHL

SEQ ID NO: 1577 - protein, 9 aa, Homo sapiens
IKIDGVEDI

SEQ ID NO: 1578 - protein, 9 aa, Homo sapiens
LLPPNLWSL

SEQ ID NO: 1579 - protein, 9 aa, Homo sapiens
WYHVRREDL

SEQ ID NO: 1580 - protein, 9 aa, Homo sapiens
TFTEELVMI

SEQ ID NO: 1581 - protein, 9 aa, Homo sapiens
CANTFTEEL

SEQ ID NO: 1582 - protein, 9 aa, Homo sapiens
RATPTPGIM

SEQ ID NO: 1583 - protein, 9 aa, Homo sapiens
KRAPAKHLI

SEQ ID NO: 1584 - protein, 9 aa, Homo sapiens
QYMKQSMPR

SEQ ID NO: 1585 - protein, 9 aa, Homo sapiens
FDNSGIQYM

SEQ ID NO: 1586 - protein, 9 aa, Homo sapiens
DAADFIRAA

SEQ ID NO: 1587 - protein, 9 aa, Homo sapiens
FIRAARDIF

SEQ ID NO: 1588 - protein, 9 aa, Homo sapiens
FSQKQIIFL

SEQ ID NO: 1589 - protein, 9 aa, Homo sapiens
FFMSLLNFF

SEQ ID NO: 1590 - protein, 9 aa, Homo sapiens
SLLNFFNNF

SEQ ID NO: 1591 - protein, 9 aa, Homo sapiens
SLLNFFNNF

SEQ ID NO: 1592 - protein, 9 aa, Homo sapiens
FFMSLLNFF

SEQ ID NO: 1593 - protein, 9 aa, Homo sapiens
FYVNNNLYI

SEQ ID NO: 1594 - protein, 9 aa, Homo sapiens
YVNNNLYIF

SEQ ID NO: 1595 - protein, 9 aa, Homo sapiens
YVNNNLYIF

SEQ ID NO: 1596 - protein, 9 aa, Homo sapiens
LFYVNNNLY

SEQ ID NO: 1597 - protein, 9 aa, Homo sapiens
FYVNNNLYI

SEQ ID NO: 1598 - protein, 9 aa, Homo sapiens
YVNNNLYIF

SEQ ID NO: 1599 - protein, 9 aa, Homo sapiens
LALILLVSY

SEQ ID NO: 1600 - protein, 9 aa, Homo sapiens
GFFRAAGHL

SEQ ID NO: 1601 - protein, 9 aa, Homo sapiens
FFRAAGHLL

SEQ ID NO: 1602 - protein, 9 aa, Homo sapiens
GFCDPYCML

SEQ ID NO: 1603 - protein, 9 aa, Homo sapiens
YLPGRATSM

SEQ ID NO: 1604 - protein, 9 aa, Homo sapiens
NWYGSAVPL

SEQ ID NO: 1605 - protein, 9 aa, Homo sapiens
RALGSTWAI

SEQ ID NO: 1606 - protein, 9 aa, Homo sapiens
RALGSTWAI

SEQ ID NO: 1607 - protein, 9 aa, Homo sapiens
RALGSTWAI

SEQ ID NO: 1608 - protein, 9 aa, Homo sapiens
STLLLNSLF

SEQ ID NO: 1609 - protein, 9 aa, Homo sapiens
AAENCIGIL

SEQ ID NO: 1610 - protein, 9 aa, Homo sapiens
RQGPWVALF

SEQ ID NO: 1611 - protein, 9 aa, Homo sapiens
RQGPWVALF

SEQ ID NO: 1612 - protein, 9 aa, Homo sapiens
RQGPWVALF

SEQ ID NO: 1613 - protein, 9 aa, Homo sapiens
WVALFVRTM

SEQ ID NO: 1614 - protein, 9 aa, Homo sapiens
RSHSIETMV

SEQ ID NO: 1615 - protein, 9 aa, Homo sapiens
FNPPDLDII

SEQ ID NO: 1616 - protein, 9 aa, Homo sapiens
LVLLLVSTI

SEQ ID NO: 1617 - protein, 9 aa, Homo sapiens
VAVLVLLLV

SEQ ID NO: 1618 - protein, 9 aa, Homo sapiens
LVLLLVSTI

SEQ ID NO: 1619 - protein, 9 aa, Homo sapiens
FMQTPEQEM

SEQ ID NO: 1620 - protein, 9 aa, Homo sapiens
MQTPEQEMV

SEQ ID NO: 1621 - protein, 9 aa, Homo sapiens
VFYPQKQEI

SEQ ID NO: 1622 - protein, 9 aa, Homo sapiens
VFYPQKQEI

SEQ ID NO: 1623 - protein, 9 aa, Homo sapiens
YPQKQEITL

SEQ ID NO: 1624 - protein, 9 aa, Homo sapiens
FINGPNNAY

SEQ ID NO: 1625 - protein, 9 aa, Homo sapiens
SMSTVDCPF

SEQ ID NO: 1626 - protein, 9 aa, Homo sapiens
STVDCPFTV

SEQ ID NO: 1627 - protein, 9 aa, Homo sapiens
LYALDRKAL

SEQ ID NO: 1628 - protein, 9 aa, Homo sapiens
YALDRKALA

SEQ ID NO: 1629 - protein, 9 aa, Homo sapiens
LAKDNFEIL

SEQ ID NO: 1630 - protein, 9 aa, Homo sapiens
QADLEVAAL

SEQ ID NO: 1631 - protein, 9 aa, Homo sapiens
CAASSLPLV

SEQ ID NO: 1632 - protein, 9 aa, Homo sapiens
LVDDVLASL

SEQ ID NO: 1633 - protein, 9 aa, Homo sapiens
EYLEVQWQL

SEQ ID NO: 1634 - protein, 9 aa, Homo sapiens
QWQLAIQRL

SEQ ID NO: 1635 - protein, 9 aa, Homo sapiens
KQEYLEVQW

SEQ ID NO: 1636 - protein, 9 aa, Homo sapiens
RTQADLDSI

SEQ ID NO: 1637 - protein, 9 aa, Homo sapiens
HYSGDSLGW

SEQ ID NO: 1638 - protein, 9 aa, Homo sapiens
VVHTETKTV

SEQ ID NO: 1639 - protein, 9 aa, Homo sapiens
HTETKTVTY

SEQ ID NO: 1640 - protein, 9 aa, Homo sapiens
KADDVVPEL

SEQ ID NO: 1641 - protein, 9 aa, Homo sapiens
THLDFITIL

SEQ ID NO: 1642 - protein, 9 aa, Homo sapiens
LLFTHLDFI

SEQ ID NO: 1643 - protein, 9 aa, Homo sapiens
FTHLDFITI

SEQ ID NO: 1644 - protein, 9 aa, Homo sapiens
THLDFITIL

SEQ ID NO: 1645 - protein, 9 aa, Homo sapiens
EQLPPKSSY

SEQ ID NO: 1646 - protein, 9 aa, Homo sapiens
IANFAEQIV

SEQ ID NO: 1647 - protein, 9 aa, Homo sapiens
FQCSHLSSF

SEQ ID NO: 1648 - protein, 9 aa, Homo sapiens
AYVSALSLI

SEQ ID NO: 1649 - protein, 9 aa, Homo sapiens
SAYVSALSL

SEQ ID NO: 1650 - protein, 9 aa, Homo sapiens
YVSALSLII

SEQ ID NO: 1651 - protein, 9 aa, Homo sapiens
QQGDFPGTY

SEQ ID NO: 1652 - protein, 9 aa, Homo sapiens
KAFNSSSTI

SEQ ID NO: 1653 - protein, 9 aa, Homo sapiens
KAFNSSSTI

SEQ ID NO: 1654 - protein, 9 aa, Homo sapiens
IAPPKPDLI

SEQ ID NO: 1655 - protein, 9 aa, Homo sapiens
LSIGLLTSV

SEQ ID NO: 1656 - protein, 9 aa, Homo sapiens
YIIFRWSDI

SEQ ID NO: 1657 - protein, 9 aa, Homo sapiens
YIIFRVSDI

SEQ ID NO: 1658 - protein, 9 aa, Homo sapiens
NWICFYSII

SEQ ID NO: 1659 - protein, 9 aa, Homo sapiens
CFYSIIFRW

SEQ ID NO: 1660 - protein, 9 aa, Homo sapiens
IIFRWETTI

SEQ ID NO: 1661 - protein, 9 aa, Homo sapiens
IIFRWETTI

SEQ ID NO: 1662 - protein, 9 aa, Homo sapiens
QAVAPSVLV

SEQ ID NO: 1663 - protein, 9 aa, Homo sapiens
KVFSLSSYL

SEQ ID NO: 1664 - protein, 9 aa, Homo sapiens
KVFSLSSYL

SEQ ID NO: 1665 - protein, 9 aa, Homo sapiens
LVPEAPRSV

SEQ ID NO: 1666 - protein, 9 aa, Homo sapiens
TYMKSEDPL

SEQ ID NO: 1667 - protein, 9 aa, Homo sapiens
SAAKGVATY

SEQ ID NO: 1668 - protein, 9 aa, Homo sapiens
IFNNYRNNF

SEQ ID NO: 1669 - protein, 9 aa, Homo sapiens
FVNLSDNEL

SEQ ID NO: 1670 - protein, 9 aa, Homo sapiens
LQDDSIKLL

SEQ ID NO: 1671 - protein, 9 aa, Homo sapiens
FTSNPVDLF

SEQ ID NO: 1672 - protein, 9 aa, Homo sapiens
FTSNPVDLF

SEQ ID NO: 1673 - protein, 9 aa, Homo sapiens
RTLNAKNGL

SEQ ID NO: 1674 - protein, 9 aa, Homo sapiens
RVHSGEGPF

SEQ ID NO: 1675 - protein, 9 aa, Homo sapiens
RVHSGEGPF

SEQ ID NO: 1676 - protein, 9 aa, Homo sapiens
RYIEFYSQS

SEQ ID NO: 1677 - protein, 9 aa, Homo sapiens
FYSQSGFYY

SEQ ID NO: 1678 - protein, 9 aa, Homo sapiens
YPDVNHANV

SEQ ID NO: 1679 - protein, 9 aa, Homo sapiens
FIIEGQIYV

SEQ ID NO: 1680 - protein, 9 aa, Homo sapiens
IQWNWSTYL

SEQ ID NO: 1681 - protein, 9 aa, Homo sapiens
FIQWNWSTY

SEQ ID NO: 1682 - protein, 9 aa, Homo sapiens
IQWNWSTYL

SEQ ID NO: 1683 - protein, 9 aa, Homo sapiens
SWILEAAGF

SEQ ID NO: 1684 - protein, 9 aa, Homo sapiens
RRDHMMDAI

SEQ ID NO: 1685 - protein, 9 aa, Homo sapiens
THVGFPEYL

SEQ ID NO: 1686 - protein, 9 aa, Homo sapiens
HYHKVMEEI

SEQ ID NO: 1687 - protein, 9 aa, Homo sapiens
MAFNYHYHK

SEQ ID NO: 1688 - protein, 9 aa, Homo sapiens
FNYHYHKVM

SEQ ID NO: 1689 - protein, 9 aa, Homo sapiens
GFHVCTAGW

SEQ ID NO: 1690 - protein, 9 aa, Homo sapiens
EYKKYFEKW

SEQ ID NO: 1691 - protein, 9 aa, Homo sapiens
YFEKWKTKF

SEQ ID NO: 1692 - protein, 9 aa, Homo sapiens
RSGCISQSI

SEQ ID NO: 1693 - protein, 9 aa, Homo sapiens
IFFVVESFL

SEQ ID NO: 1694 - protein, 9 aa, Homo sapiens
FFVVESFLF

SEQ ID NO: 1695 - protein, 9 aa, Homo sapiens
MIFFVVESF

SEQ ID NO: 1696 - protein, 9 aa, Homo sapiens
VVESFLFSF

SEQ ID NO: 1697 - protein, 9 aa, Homo sapiens
MIFFVVESF

SEQ ID NO: 1698 - protein, 9 aa, Homo sapiens
LDLDSITKI

SEQ ID NO: 1699 - protein, 9 aa, Homo sapiens
DSITKILSV

SEQ ID NO: 1700 - protein, 9 aa, Homo sapiens
DYMYDKEYL

SEQ ID NO: 1701 - protein, 9 aa, Homo sapiens
HPNVHGPEI

SEQ ID NO: 1702 - protein, 9 aa, Homo sapiens
FEVPARSNF

SEQ ID NO: 1703 - protein, 9 aa, Homo sapiens
QVIQPVKSI

SEQ ID NO: 1704 - protein, 9 aa, Homo sapiens
DADINDERV

SEQ ID NO: 1705 - protein, 9 aa, Homo sapiens
FVVPSPVEF

SEQ ID NO: 1706 - protein, 9 aa, Homo sapiens
FVVPSPVEF

SEQ ID NO: 1707 - protein, 9 aa, Homo sapiens
EYCTTTGTW

SEQ ID NO: 1708 - protein, 9 aa, Homo sapiens
EAVDRRNPV

SEQ ID NO: 1709 - protein, 9 aa, Homo sapiens
QHARVLQYW

SEQ ID NO: 1710 - protein, 9 aa, Homo sapiens
QYWELLDAL

SEQ ID NO: 1711 - protein, 9 aa, Homo sapiens
LPFLHAQRY

SEQ ID NO: 1712 - protein, 9 aa, Homo sapiens
PPQTPTQTI

SEQ ID NO: 1713 - protein, 9 aa, Homo sapiens
QMLHSGTLV

SEQ ID NO: 1714 - protein, 9 aa, Homo sapiens
YFGALFKAM

SEQ ID NO: 1715 - protein, 9 aa, Homo sapiens
ALFKAMSAF

SEQ ID NO: 1716 - protein, 9 aa, Homo sapiens
IAPEAYAAY

SEQ ID NO: 1717 - protein, 9 aa, Homo sapiens
LVGETSVAV

SEQ ID NO: 1718 - protein, 9 aa, Homo sapiens
SWLGEALWL

SEQ ID NO: 1719 - protein, 9 aa, Homo sapiens
LWLALVSLF

SEQ ID NO: 1720 - protein, 9 aa, Homo sapiens
ALWLALVSL

SEQ ID NO: 1721 - protein, 9 aa, Homo sapiens
VARKSVLLV

SEQ ID NO: 1722 - protein, 9 aa, Homo sapiens
FRLHNKPTF

SEQ ID NO: 1723 - protein, 9 aa, Homo sapiens
YALMKSNPL

SEQ ID NO: 1724 - protein, 9 aa, Homo sapiens
KFGAQGSCF

SEQ ID NO: 1725 - protein, 9 aa, Homo sapiens
TKEELIFLL

SEQ ID NO: 1726 - protein, 9 aa, Homo sapiens
MTKEELIFL

SEQ ID NO: 1727 - protein, 9 aa, Homo sapiens
QPEPGPDRV

SEQ ID NO: 1728 - protein, 9 aa, Homo sapiens
WYYFDDSNL

SEQ ID NO: 1729 - protein, 9 aa, Homo sapiens
YFDDSNLSL

SEQ ID NO: 1730 - protein, 9 aa, Homo sapiens
DAQCQTLAL

SEQ ID NO: 1731 - protein, 9 aa, Homo sapiens
QASEANLQV

SEQ ID NO: 1732 - protein, 9 aa, Homo sapiens
VAQDFVRGF

SEQ ID NO: 1733 - protein, 9 aa, Homo sapiens
RAVAITVPM

SEQ ID NO: 1734 - protein, 9 aa, Homo sapiens
RAVAITVPM

SEQ ID NO: 1735 - protein, 9 aa, Homo sapiens
VAITVPMVV

SEQ ID NO: 1736 - protein, 9 aa, Homo sapiens
QAYQKKGSF

SEQ ID NO: 1737 - protein, 9 aa, Homo sapiens
AVNEFAKEI

SEQ ID NO: 1738 - protein, 9 aa, Homo sapiens
MTFKNDYQY

SEQ ID NO: 1739 - protein, 9 aa, Homo sapiens
MTFKNDYQY

SEQ ID NO: 1740 - protein, 9 aa, Homo sapiens
SLPSEPLEF

SEQ ID NO: 1741 - protein, 9 aa, Homo sapiens
LPSEPLEFV

SEQ ID NO: 1742 - protein, 9 aa, Homo sapiens
YPTGVLKQL

SEQ ID NO: 1743 - protein, 9 aa, Homo sapiens
GSMPLFHSI

SEQ ID NO: 1744 - protein, 9 aa, Homo sapiens
GSMPLFHSI

SEQ ID NO: 1745 - protein, 9 aa, Homo sapiens
GSMPLFHSI

SEQ ID NO: 1746 - protein, 9 aa, Homo sapiens
MPLFHSIHL

SEQ ID NO: 1747 - protein, 9 aa, Homo sapiens
KWMGVMHGY

SEQ ID NO: 1748 - protein, 9 aa, Homo sapiens
DPSQFGSSV

SEQ ID NO: 1749 - protein, 9 aa, Homo sapiens
LMSPEGQVL

SEQ ID NO: 1750 - protein, 9 aa, Homo sapiens
LFMREYLEV

SEQ ID NO: 1751 - protein, 9 aa, Homo sapiens
AFLMGGQIL

SEQ ID NO: 1752 - protein, 9 aa, Homo sapiens
FAFLMGGQI

SEQ ID NO: 1753 - protein, 9 aa, Homo sapiens
SVLACVIMV

SEQ ID NO: 1754 - protein, 9 aa, Homo sapiens
LACVIMVSL

SEQ ID NO: 1755 - protein, 9 aa, Homo sapiens
ICLHETNFV

SEQ ID NO: 1756 - protein, 9 aa, Homo sapiens
TNFVPGKSI

SEQ ID NO: 1757 - protein, 9 aa, Homo sapiens
CYAGQFFQP

SEQ ID NO: 1758 - protein, 9 aa, Homo sapiens
AFCVSTWVF

SEQ ID NO: 1759 - protein, 9 aa, Homo sapiens
STWVFTATQ

SEQ ID NO: 1760 - protein, 9 aa, Homo sapiens
TAFCVSTWV

SEQ ID NO: 1761 - protein, 9 aa, Homo sapiens
NLKEKIAVL

SEQ ID NO: 1762 - protein, 9 aa, Homo sapiens
VWPTEYSYW

SEQ ID NO: 1763 - protein, 9 aa, Homo sapiens
SYWINMKTI

SEQ ID NO: 1764 - protein, 9 aa, Homo sapiens
YWINMKTIL

SEQ ID NO: 1765 - protein, 9 aa, Homo sapiens
LVWPTEYSY

SEQ ID NO: 1766 - protein, 9 aa, Homo sapiens
YSYWINMKT

SEQ ID NO: 1767 - protein, 9 aa, Homo sapiens
RALRTVITY

SEQ ID NO: 1768 - protein, 9 aa, Homo sapiens
RALRTVITY

SEQ ID NO: 1769 - protein, 9 aa, Homo sapiens
YSSYKENAM

SEQ ID NO: 1770 - protein, 9 aa, Homo sapiens
NVLRKPKKY

SEQ ID NO: 1771 - protein, 9 aa, Homo sapiens
CMPKATVQI

SEQ ID NO: 1772 - protein, 9 aa, Homo sapiens
LACMPKATV

SEQ ID NO: 1773 - protein, 9 aa, Homo sapiens
ERYQLKESL

SEQ ID NO: 1774 - protein, 9 aa, Homo sapiens
QLKARRKVV

SEQ ID NO: 1775 - protein, 9 aa, Homo sapiens
KARRKVVKM

SEQ ID NO: 1776 - protein, 9 aa, Homo sapiens
EYVKQQVSL

SEQ ID NO: 1777 - protein, 9 aa, Homo sapiens
EADQIIEYV

SEQ ID NO: 1778 - protein, 9 aa, Homo sapiens
YVKQQVSLL

SEQ ID NO: 1779 - protein, 9 aa, Homo sapiens
FRLNLFNNL

SEQ ID NO: 1780 - protein, 9 aa, Homo sapiens
MELKTVKHI

SEQ ID NO: 1781 - protein, 9 aa, Homo sapiens
SFLTLIVLL

SEQ ID NO: 1782 - protein, 9 aa, Homo sapiens
KLRRSFLTL

SEQ ID NO: 1783 - protein, 9 aa, Homo sapiens
RSFLTLIVL

SEQ ID NO: 1784 - protein, 9 aa, Homo sapiens
SKSNDNFLL

SEQ ID NO: 1785 - protein, 9 aa, Homo sapiens
FFAFIIGMF

SEQ ID NO: 1786 - protein, 9 aa, Homo sapiens
AFIIGMFIL

SEQ ID NO: 1787 - protein, 9 aa, Homo sapiens
IMVFFAFII

SEQ ID NO: 1788 - protein, 9 aa, Homo sapiens
FIMVFFAFI

SEQ ID NO: 1789 - protein, 9 aa, Homo sapiens
IMVFFAFII

SEQ ID NO: 1790 - protein, 9 aa, Homo sapiens
FAFIIGMFI

SEQ ID NO: 1791 - protein, 9 aa, Homo sapiens
FIIGMFILY

SEQ ID NO: 1792 - protein, 9 aa, Homo sapiens
MYFGEHLLF

SEQ ID NO: 1793 - protein, 9 aa, Homo sapiens
RMYFGEHLL

SEQ ID NO: 1794 - protein, 9 aa, Homo sapiens
EHLLFSGTL

SEQ ID NO: 1795 - protein, 9 aa, Homo sapiens
RMYFGEHLL

SEQ ID NO: 1796 - protein, 9 aa, Homo sapiens
DYVRSRCQF

SEQ ID NO: 1797 - protein, 9 aa, Homo sapiens
FCKRCLLEI

SEQ ID NO: 1798 - protein, 9 aa, Homo sapiens
VSFDGTIKV

SEQ ID NO: 1799 - protein, 9 aa, Homo sapiens
RAKALFSVL

SEQ ID NO: 1800 - protein, 9 aa, Homo sapiens
IAIIGLILL

SEQ ID NO: 1801 - protein, 9 aa, Homo sapiens
KLAINGTII

SEQ ID NO: 1802 - protein, 9 aa, Homo sapiens
LAINGTIIM

SEQ ID NO: 1803 - protein, 9 aa, Homo sapiens
YFTSPACTF

SEQ ID NO: 1804 - protein, 9 aa, Homo sapiens
YFTSPACTF

SEQ ID NO: 1805 - protein, 9 aa, Homo sapiens
FTSPACTFL

SEQ ID NO: 1806 - protein, 9 aa, Homo sapiens
FYTERSPAV

SEQ ID NO: 1807 - protein, 9 aa, Homo sapiens
YTERSPAVI

SEQ ID NO: 1808 - protein, 9 aa, Homo sapiens
NSFPESEGY

SEQ ID NO: 1809 - protein, 9 aa, Homo sapiens
ALHRAFQAW

SEQ ID NO: 1810 - protein, 9 aa, Homo sapiens
DAKNSVEEY

SEQ ID NO: 1811 - protein, 9 aa, Homo sapiens
AHDQGSPTL

SEQ ID NO: 1812 - protein, 9 aa, Homo sapiens
QAHDQGSPT

SEQ ID NO: 1813 - protein, 9 aa, Homo sapiens
HLSPQAVLF

SEQ ID NO: 1814 - protein, 9 aa, Homo sapiens
RILCIVWGF

SEQ ID NO: 1815 - protein, 9 aa, Homo sapiens
RILCIVWGF

SEQ ID NO: 1816 - protein, 9 aa, Homo sapiens
RALRILCIV

SEQ ID NO: 1817 - protein, 9 aa, Homo sapiens
FAKEAAAVG

SEQ ID NO: 1818 - protein, 9 aa, Homo sapiens
AFFTCASHL

SEQ ID NO: 1819 - protein, 9 aa, Homo sapiens
FTCASHLAI

SEQ ID NO: 1820 - protein, 9 aa, Homo sapiens
KSMAGNFLV

SEQ ID NO: 1821 - protein, 9 aa, Homo sapiens
RLPTVTTGW

SEQ ID NO: 1822 - protein, 9 aa, Homo sapiens
PLLALTWMF

SEQ ID NO: 1823 - protein, 9 aa, Homo sapiens
PLLALTWMF

SEQ ID NO: 1824 - protein, 9 aa, Homo sapiens
LALTWMFAV

SEQ ID NO: 1825 - protein, 9 aa, Homo sapiens
RGVERIPHV

SEQ ID NO: 1826 - protein, 9 aa, Homo sapiens
NSCRFGKFV

SEQ ID NO: 1827 - protein, 9 aa, Homo sapiens
IFMFFVLAL

SEQ ID NO: 1828 - protein, 9 aa, Homo sapiens
FMFFVLALL

SEQ ID NO: 1829 - protein, 9 aa, Homo sapiens
IWLVLGGFI

SEQ ID NO: 1830 - protein, 9 aa, Homo sapiens
VSMAIWLVL

SEQ ID NO: 1831 - protein, 9 aa, Homo sapiens
LSHNFHRAL

SEQ ID NO: 1832 - protein, 9 aa, Homo sapiens
SVLCFTTPV

SEQ ID NO: 1833 - protein, 9 aa, Homo sapiens
SVLCFTTPV

SEQ ID NO: 1834 - protein, 9 aa, Homo sapiens
KSLIHSVLL

SEQ ID NO: 1835 - protein, 9 aa, Homo sapiens
IQKDKDIPV

SEQ ID NO: 1836 - protein, 9 aa, Homo sapiens
YLRPLWRHI

SEQ ID NO: 1837 - protein, 9 aa, Homo sapiens
HWQQLMKAI

SEQ ID NO: 1838 - protein, 9 aa, Homo sapiens
HWHELMKAI

SEQ ID NO: 1839 - protein, 9 aa, Homo sapiens
KSAQIPSPL

SEQ ID NO: 1840 - protein, 9 aa, Homo sapiens
ELLDNAAQI

SEQ ID NO: 1841 - protein, 9 aa, Homo sapiens
NAAQIPSPL

SEQ ID NO: 1842 - protein, 9 aa, Homo sapiens
QILLNGYNI

SEQ ID NO: 1843 - protein, 9 aa, Homo sapiens
NGYNITMLV

SEQ ID NO: 1844 - protein, 9 aa, Homo sapiens
RVKNSAAPI

SEQ ID NO: 1845 - protein, 9 aa, Homo sapiens
RATTPSVRV

SEQ ID NO: 1846 - protein, 9 aa, Homo sapiens
RVKNSAAPI

SEQ ID NO: 1847 - protein, 9 aa, Homo sapiens
LPLGAACSV

SEQ ID NO: 1848 - protein, 9 aa, Homo sapiens
VSAAIPCSI

SEQ ID NO: 1849 - protein, 9 aa, Homo sapiens
RAVAVNGPV

SEQ ID NO: 1850 - protein, 9 aa, Homo sapiens
VSAALRRSF

SEQ ID NO: 1851 - protein, 9 aa, Homo sapiens
LARPVSAAL

SEQ ID NO: 1852 - protein, 9 aa, Homo sapiens
KTADEKVIF

SEQ ID NO: 1853 - protein, 9 aa, Homo sapiens
IYFTFYDQL

SEQ ID NO: 1854 - protein, 9 aa, Homo sapiens
TFYDQLSAL

SEQ ID NO: 1855 - protein, 9 aa, Homo sapiens
FYDQLSALL

SEQ ID NO: 1856 - protein, 9 aa, Homo sapiens
TFYDQLSAL

SEQ ID NO: 1857 - protein, 9 aa, Homo sapiens
WAVSLHGKV

SEQ ID NO: 1858 - protein, 9 aa, Homo sapiens
FKSPDAFRV

SEQ ID NO: 1859 - protein, 9 aa, Homo sapiens
DAFRVSLPL

SEQ ID NO: 1860 - protein, 9 aa, Homo sapiens
LMERLPVTW

SEQ ID NO: 1861 - protein, 9 aa, Homo sapiens
ERLPVTWVL

SEQ ID NO: 1862 - protein, 9 aa, Homo sapiens
FLMERLPVT

SEQ ID NO: 1863 - protein, 9 aa, Homo sapiens
KFHRNRVRI

SEQ ID NO: 1864 - protein, 9 aa, Homo sapiens
RLQIINSKW

SEQ ID NO: 1865 - protein, 9 aa, Homo sapiens
LNSNRLQII

SEQ ID NO: 1866 - protein, 9 aa, Homo sapiens
NPKSWYEYV

SEQ ID NO: 1867 - protein, 9 aa, Homo sapiens
YEYVEGCGI

SEQ ID NO: 1868 - protein, 9 aa, Homo sapiens
IEYLEHVKV

SEQ ID NO: 1869 - protein, 9 aa, Homo sapiens
SYDVALHRM

SEQ ID NO: 1870 - protein, 9 aa, Homo sapiens
VSSDCTNHF

SEQ ID NO: 1871 - protein, 9 aa, Homo sapiens
NPNVNTGII

SEQ ID NO: 1872 - protein, 9 aa, Homo sapiens
QVKRKRYTV

SEQ ID NO: 1873 - protein, 9 aa, Homo sapiens
YTVDLEFKI

SEQ ID NO: 1874 - protein, 9 aa, Homo sapiens
LHVNDLEFL

SEQ ID NO: 1875 - protein, 9 aa, Homo sapiens
FTPQLPGKV

SEQ ID NO: 1876 - protein, 9 aa, Homo sapiens
VSSENFDYY

SEQ ID NO: 1877 - protein, 9 aa, Homo sapiens
RVPPPPGAV

SEQ ID NO: 1878 - protein, 9 aa, Homo sapiens
VPPPPGAVI

SEQ ID NO: 1879 - protein, 9 aa, Homo sapiens
SARAAMQQF

SEQ ID NO: 1880 - protein, 9 aa, Homo sapiens
LANEEVKKL

SEQ ID NO: 1881 - protein, 9 aa, Homo sapiens
EILEGSQLV

SEQ ID NO: 1882 - protein, 9 aa, Homo sapiens
SNMELLLSW

SEQ ID NO: 1883 - protein, 9 aa, Homo sapiens
FWSKYKLSF

SEQ ID NO: 1884 - protein, 9 aa, Homo sapiens
SFPGNPHYL

SEQ ID NO: 1885 - protein, 9 aa, Homo sapiens
LSFPGNPHY

SEQ ID NO: 1886 - protein, 9 aa, Homo sapiens
TAKSATVNL

SEQ ID NO: 1887 - protein, 9 aa, Homo sapiens
KIEEAKLSF

SEQ ID NO: 1888 - protein, 9 aa, Homo sapiens
RFSEAFFYI

SEQ ID NO: 1889 - protein, 9 aa, Homo sapiens
FFYIEHQKL

SEQ ID NO: 1890 - protein, 9 aa, Homo sapiens
FFYIEHQKL

SEQ ID NO: 1891 - protein, 9 aa, Homo sapiens
YIEHQKLAV

SEQ ID NO: 1892 - protein, 9 aa, Homo sapiens
TFKDFYNFW

SEQ ID NO: 1893 - protein, 9 aa, Homo sapiens
ETFKDFYNF

SEQ ID NO: 1894 - protein, 9 aa, Homo sapiens
SAGSSPKVL

SEQ ID NO: 1895 - protein, 9 aa, Homo sapiens
RSSQQVVAV

SEQ ID NO: 1896 - protein, 9 aa, Homo sapiens
RMIRSSQQV

SEQ ID NO: 1897 - protein, 9 aa, Homo sapiens
RSSQQVVAV

SEQ ID NO: 1898 - protein, 9 aa, Homo sapiens
KISIYQAMW

SEQ ID NO: 1899 - protein, 9 aa, Homo sapiens
YDYVRRRLM

SEQ ID NO: 1900 - protein, 9 aa, Homo sapiens
VYDAAREGF

SEQ ID NO: 1901 - protein, 9 aa, Homo sapiens
KHPSVNKNF

SEQ ID NO: 1902 - protein, 9 aa, Homo sapiens
RVHQCDHPV

SEQ ID NO: 1903 - protein, 9 aa, Homo sapiens
LSTDPTAAF

SEQ ID NO: 1904 - protein, 9 aa, Homo sapiens
YGRECASGY

SEQ ID NO: 1905 - protein, 9 aa, Homo sapiens
DSIHGPLNI

SEQ ID NO: 1906 - protein, 9 aa, Homo sapiens
LARPGREGL

SEQ ID NO: 1907 - protein, 9 aa, Homo sapiens
DAAPIVYPL

SEQ ID NO: 1908 - protein, 9 aa, Homo sapiens
QFQRAPLGI

SEQ ID NO: 1909 - protein, 9 aa, Homo sapiens
LPDLLTATV

SEQ ID NO: 1910 - protein, 9 aa, Homo sapiens
VYHPTSQRV

SEQ ID NO: 1911 - protein, 9 aa, Homo sapiens
QSLQMTYHL

SEQ ID NO: 1912 - protein, 9 aa, Homo sapiens
YHPERLHHY

SEQ ID NO: 1913 - protein, 9 aa, Homo sapiens
HHYINPEPM

SEQ ID NO: 1914 - protein, 9 aa, Homo sapiens
TYGSHLSVV

SEQ ID NO: 1915 - protein, 9 aa, Homo sapiens
STYGSHLSV

SEQ ID NO: 1916 - protein, 9 aa, Homo sapiens
STYGSHLSV

SEQ ID NO: 1917 - protein, 9 aa, Homo sapiens
LEMDSVLEV

SEQ ID NO: 1918 - protein, 9 aa, Homo sapiens
KALINAYEL

SEQ ID NO: 1919 - protein, 9 aa, Homo sapiens
NAYELASDV

SEQ ID NO: 1920 - protein, 9 aa, Homo sapiens
VWEHLYNIF

SEQ ID NO: 1921 - protein, 9 aa, Homo sapiens
NVWEHLYNI

SEQ ID NO: 1922 - protein, 9 aa, Homo sapiens
NVWEHLYNI

SEQ ID NO: 1923 - protein, 9 aa, Homo sapiens
NIFGGGPAV

SEQ ID NO: 1924 - protein, 9 aa, Homo sapiens
WLFAINIYF

SEQ ID NO: 1925 - protein, 9 aa, Homo sapiens
IYFNAFWTI

SEQ ID NO: 1926 - protein, 9 aa, Homo sapiens
VVWLFAINI

SEQ ID NO: 1927 - protein, 9 aa, Homo sapiens
WLFAINIYF

SEQ ID NO: 1928 - protein, 9 aa, Homo sapiens
AINIYFNAF

SEQ ID NO: 1929 - protein, 9 aa, Homo sapiens
IYFNAFWTI

SEQ ID NO: 1930 - protein, 9 aa, Homo sapiens
IYFNAFWTI

SEQ ID NO: 1931 - protein, 9 aa, Homo sapiens
TPLTPRHSI

SEQ ID NO: 1932 - protein, 9 aa, Homo sapiens
LTPRHSITY

SEQ ID NO: 1933 - protein, 9 aa, Homo sapiens
VFGVLLCNL

SEQ ID NO: 1934 - protein, 9 aa, Homo sapiens
LCNLVTVAF

SEQ ID NO: 1935 - protein, 9 aa, Homo sapiens
VLLCNLVTV

SEQ ID NO: 1936 - protein, 9 aa, Homo sapiens
RQHYALNIF

SEQ ID NO: 1937 - protein, 9 aa, Homo sapiens
YALNIFQSI

SEQ ID NO: 1938 - protein, 9 aa, Homo sapiens
RQHYALNIF

SEQ ID NO: 1939 - protein, 9 aa, Homo sapiens
YALNIFQSI

SEQ ID NO: 1940 - protein, 9 aa, Homo sapiens
MPKLGGRSV

SEQ ID NO: 1941 - protein, 9 aa, Homo sapiens
FVVRRITEL

SEQ ID NO: 1942 - protein, 9 aa, Homo sapiens
LIFFPAYFI

SEQ ID NO: 1943 - protein, 9 aa, Homo sapiens
LIFFPAYFI

SEQ ID NO: 1944 - protein, 9 aa, Homo sapiens
FPAYFINAV

SEQ ID NO: 1945 - protein, 9 aa, Homo sapiens
YEKRRLLTV

SEQ ID NO: 1946 - protein, 9 aa, Homo sapiens
TYRDLILKW

SEQ ID NO: 1947 - protein, 9 aa, Homo sapiens
FLEDDAEDI

SEQ ID NO: 1948 - protein, 9 aa, Homo sapiens
LINLWNTCF

SEQ ID NO: 1949 - protein, 9 aa, Homo sapiens
ITCSVINRV

SEQ ID NO: 1950 - protein, 9 aa, Homo sapiens
SVINRVQKV

SEQ ID NO: 1951 - protein, 9 aa, Homo sapiens
RHQSERQEL

SEQ ID NO: 1952 - protein, 9 aa, Homo sapiens
RFHSIIPSY

SEQ ID NO: 1953 - protein, 9 aa, Homo sapiens
FHSIIPSYI

SEQ ID NO: 1954 - protein, 9 aa, Homo sapiens
ISLVAANRV

SEQ ID NO: 1955 - protein, 9 aa, Homo sapiens
VLAMANVGI

SEQ ID NO: 1956 - protein, 9 aa, Homo sapiens
FTRICCDPV

SEQ ID NO: 1957 - protein, 9 aa, Homo sapiens
VYKTGNVPL

SEQ ID NO: 1958 - protein, 9 aa, Homo sapiens
YKTGNVPLI

SEQ ID NO: 1959 - protein, 9 aa, Homo sapiens
RRNSMAATL

SEQ ID NO: 1960 - protein, 9 aa, Homo sapiens
IILNRRNSM

SEQ ID NO: 1961 - protein, 9 aa, Homo sapiens
NSMAATLKI

SEQ ID NO: 1962 - protein, 9 aa, Homo sapiens
LMGCDIDII

SEQ ID NO: 1963 - protein, 9 aa, Homo sapiens
RQLWVGYSL

SEQ ID NO: 1964 - protein, 9 aa, Homo sapiens
RQLWVGYSL

SEQ ID NO: 1965 - protein, 9 aa, Homo sapiens
YLQHASWAF

SEQ ID NO: 1966 - protein, 9 aa, Homo sapiens
SWAFTVNGL

SEQ ID NO: 1967 - protein, 9 aa, Homo sapiens
YLQHASWAF

SEQ ID NO: 1968 - protein, 9 aa, Homo sapiens
QHASWAFTV

SEQ ID NO: 1969 - protein, 9 aa, Homo sapiens
WAFTVNGLI

SEQ ID NO: 1970 - protein, 9 aa, Homo sapiens
KSFKSHISV

SEQ ID NO: 1971 - protein, 9 aa, Homo sapiens
KQKSFKSHI

SEQ ID NO: 1972 - protein, 9 aa, Homo sapiens
KSFKSHISV

SEQ ID NO: 1973 - protein, 9 aa, Homo sapiens
LMVGPHAPV

SEQ ID NO: 1974 - protein, 9 aa, Homo sapiens
TYRSMANYL

SEQ ID NO: 1975 - protein, 9 aa, Homo sapiens
RSMANYLKV

SEQ ID NO: 1976 - protein, 9 aa, Homo sapiens
IYCIGLQEL

SEQ ID NO: 1977 - protein, 9 aa, Homo sapiens
KKMDTMYPF

SEQ ID NO: 1978 - protein, 9 aa, Homo sapiens
IFWKTCIFW

SEQ ID NO: 1979 - protein, 9 aa, Homo sapiens
CIFWKTWIF

SEQ ID NO: 1980 - protein, 9 aa, Homo sapiens
WIFWKTCIF

SEQ ID NO: 1981 - protein, 9 aa, Homo sapiens
KTCIFWKTW

SEQ ID NO: 1982 - protein, 9 aa, Homo sapiens
CIFWKTWIF

SEQ ID NO: 1983 - protein, 9 aa, Homo sapiens
VSVKNVLYV

SEQ ID NO: 1984 - protein, 9 aa, Homo sapiens
QHYKPEEGL

SEQ ID NO: 1985 - protein, 9 aa, Homo sapiens
RSHTGEWPY

SEQ ID NO: 1986 - protein, 9 aa, Homo sapiens
KLTNIWEEL

SEQ ID NO: 1987 - protein, 9 aa, Homo sapiens
LTNIWEELK

SEQ ID NO: 1988 - protein, 9 aa, Homo sapiens
LERKLTNIW

SEQ ID NO: 1989 - protein, 9 aa, Homo sapiens
NSCTCFVNR

SEQ ID NO: 1990 - protein, 9 aa, Homo sapiens
FLHVLGDAV

SEQ ID NO: 1991 - protein, 9 aa, Homo sapiens
VLGDAVGSV

SEQ ID NO: 1992 - protein, 9 aa, Homo sapiens
AVGSVIVVV

SEQ ID NO: 1993 - protein, 9 aa, Homo sapiens
YFLNVLFPL

SEQ ID NO: 1994 - protein, 9 aa, Homo sapiens
FLNVLFPLL

SEQ ID NO: 1995 - protein, 9 aa, Homo sapiens
VLQHYLQQL

SEQ ID NO: 1996 - protein, 9 aa, Homo sapiens
TGSDVQTSK

SEQ ID NO: 1997 - protein, 9 aa, Homo sapiens
VQTSKCHLK

SEQ ID NO: 1998 - protein, 9 aa, Homo sapiens
QTSKCHLKR

SEQ ID NO: 1999 - protein, 9 aa, Homo sapiens
HQTDVRVTK

SEQ ID NO: 2000 - protein, 9 aa, Homo sapiens
TLLSVSDYK

SEQ ID NO: 2001 - protein, 9 aa, Homo sapiens
FSLHEVSLV

SEQ ID NO: 2002 - protein, 9 aa, Homo sapiens
SLHEVSLVL

SEQ ID NO: 2003 - protein, 9 aa, Homo sapiens
ILHMVLTGA

SEQ ID NO: 2004 - protein, 9 aa, Homo sapiens
VTTDCVHSV

SEQ ID NO: 2005 - protein, 9 aa, Homo sapiens
CLDLTMQEL

SEQ ID NO: 2006 - protein, 9 aa, Homo sapiens
LLVDGRPRL

SEQ ID NO: 2007 - protein, 9 aa, Homo sapiens
ISSSFGNEK

SEQ ID NO: 2008 - protein, 9 aa, Homo sapiens
YLQNFIHGG

SEQ ID NO: 2009 - protein, 9 aa, Homo sapiens
FVYVFITHL

SEQ ID NO: 2010 - protein, 9 aa, Homo sapiens
SMSKLLLVI

SEQ ID NO: 2011 - protein, 9 aa, Homo sapiens
RMFACSKFV

SEQ ID NO: 2012 - protein, 9 aa, Homo sapiens
YLLRLAFRS

SEQ ID NO: 2013 - protein, 9 aa, Homo sapiens
RLAFRSPDV

SEQ ID NO: 2014 - protein, 9 aa, Homo sapiens
YLLFMIGYT

SEQ ID NO: 2015 - protein, 9 aa, Homo sapiens
FMIGYTSAL

SEQ ID NO: 2016 - protein, 9 aa, Homo sapiens
MIGYTSALV

SEQ ID NO: 2017 - protein, 9 aa, Homo sapiens
YTSALVSLL

SEQ ID NO: 2018 - protein, 9 aa, Homo sapiens
SLVHRHPFL

SEQ ID NO: 2019 - protein, 9 aa, Homo sapiens
FIYQYYSSI

SEQ ID NO: 2020 - protein, 9 aa, Homo sapiens
YQYYSSIKR

SEQ ID NO: 2021 - protein, 9 aa, Homo sapiens
ALANRVDAA

SEQ ID NO: 2022 - protein, 9 aa, Homo sapiens
LLLPSMLML

SEQ ID NO: 2023 - protein, 9 aa, Homo sapiens
LLPSMLMLA

SEQ ID NO: 2024 - protein, 9 aa, Homo sapiens
SMLMLAVIV

SEQ ID NO: 2025 - protein, 9 aa, Homo sapiens
MLMLAVIVA

SEQ ID NO: 2026 - protein, 9 aa, Homo sapiens
LMLAVIVAS

SEQ ID NO: 2027 - protein, 9 aa, Homo sapiens
VLREFHTYI

SEQ ID NO: 2028 - protein, 9 aa, Homo sapiens
TVLREFHTY

SEQ ID NO: 2029 - protein, 9 aa, Homo sapiens
HTYIRSMDK

SEQ ID NO: 2030 - protein, 9 aa, Homo sapiens
SSSPSAPAR

SEQ ID NO: 2031 - protein, 9 aa, Homo sapiens
ALTTCVNVV

SEQ ID NO: 2032 - protein, 9 aa, Homo sapiens
ATIGSCMVR

SEQ ID NO: 2033 - protein, 9 aa, Homo sapiens
FLFMYLVMV

SEQ ID NO: 2034 - protein, 9 aa, Homo sapiens
YLVMVAGNL

SEQ ID NO: 2035 - protein, 9 aa, Homo sapiens
VMVAGNLLI

SEQ ID NO: 2036 - protein, 9 aa, Homo sapiens
MVAGNLLII

SEQ ID NO: 2037 - protein, 9 aa, Homo sapiens
VLLLNMLIV

SEQ ID NO: 2038 - protein, 9 aa, Homo sapiens
LLLNMLIVL

SEQ ID NO: 2039 - protein, 9 aa, Homo sapiens
LLNMLIVLM

SEQ ID NO: 2040 - protein, 9 aa, Homo sapiens
RAFGRFFQK

SEQ ID NO: 2041 - protein, 9 aa, Homo sapiens
TTNTSPQQR

SEQ ID NO: 2042 - protein, 9 aa, Homo sapiens
ASYRASERK

SEQ ID NO: 2043 - protein, 9 aa, Homo sapiens
SAAAIQSQR

SEQ ID NO: 2044 - protein, 9 aa, Homo sapiens
SLRKEGFPV

SEQ ID NO: 2045 - protein, 9 aa, Homo sapiens
SVMLTSHSI

SEQ ID NO: 2046 - protein, 9 aa, Homo sapiens
KQSGDMELV

SEQ ID NO: 2047 - protein, 9 aa, Homo sapiens
GDMELVLAY

SEQ ID NO: 2048 - protein, 9 aa, Homo sapiens
MELVLAYAA

SEQ ID NO: 2049 - protein, 9 aa, Homo sapiens
LSMDRKVEK

SEQ ID NO: 2050 - protein, 9 aa, Homo sapiens
SILPMSHKI

SEQ ID NO: 2051 - protein, 9 aa, Homo sapiens
FSILPMSHK

SEQ ID NO: 2052 - protein, 9 aa, Homo sapiens
MATMRDLGK

SEQ ID NO: 2053 - protein, 9 aa, Homo sapiens
SIKSFPGDK

SEQ ID NO: 2054 - protein, 9 aa, Homo sapiens
GTGRGQLEK

SEQ ID NO: 2055 - protein, 9 aa, Homo sapiens
MLLIGSSLL

SEQ ID NO: 2056 - protein, 9 aa, Homo sapiens
LIAMYFYNM

SEQ ID NO: 2057 - protein, 9 aa, Homo sapiens
SLLAHVAGR

SEQ ID NO: 2058 - protein, 9 aa, Homo sapiens
ATMDTNVVR

SEQ ID NO: 2059 - protein, 9 aa, Homo sapiens
ILAACLENA

SEQ ID NO: 2060 - protein, 9 aa, Homo sapiens
QLYDTLDII

SEQ ID NO: 2061 - protein, 9 aa, Homo sapiens
ALDPDIIQA

SEQ ID NO: 2062 - protein, 9 aa, Homo sapiens
KISRCQFCV

SEQ ID NO: 2063 - protein, 9 aa, Homo sapiens
IQASGLLRL

SEQ ID NO: 2064 - protein, 9 aa, Homo sapiens
QIQASGLLR

SEQ ID NO: 2065 - protein, 9 aa, Homo sapiens
LTLATVTPR

SEQ ID NO: 2066 - protein, 9 aa, Homo sapiens
RQWNPRYEK

SEQ ID NO: 2067 - protein, 9 aa, Homo sapiens
YVFTEIEYK

SEQ ID NO: 2068 - protein, 9 aa, Homo sapiens
KIEVMLPEK

SEQ ID NO: 2069 - protein, 9 aa, Homo sapiens
RSFQPLVSR

SEQ ID NO: 2070 - protein, 9 aa, Homo sapiens
LLHVFKLAK

SEQ ID NO: 2071 - protein, 9 aa, Homo sapiens
GSAEGFHLH

SEQ ID NO: 2072 - protein, 9 aa, Homo sapiens
SLLCGQTPL

SEQ ID NO: 2073 - protein, 9 aa, Homo sapiens
RLVAAFEFL

SEQ ID NO: 2074 - protein, 9 aa, Homo sapiens
TLLKQVRIV

SEQ ID NO: 2075 - protein, 9 aa, Homo sapiens
HMAARAEQV

SEQ ID NO: 2076 - protein, 9 aa, Homo sapiens
LTMSVYSDR

SEQ ID NO: 2077 - protein, 9 aa, Homo sapiens
FMPNCLFFG

SEQ ID NO: 2078 - protein, 9 aa, Homo sapiens
TLINQMAPA

SEQ ID NO: 2079 - protein, 9 aa, Homo sapiens
LINQMAPAV

SEQ ID NO: 2080 - protein, 9 aa, Homo sapiens
NQMAPAVSK

SEQ ID NO: 2081 - protein, 9 aa, Homo sapiens
LIFNMLYWI

SEQ ID NO: 2082 - protein, 9 aa, Homo sapiens
MLYWIIYKI

SEQ ID NO: 2083 - protein, 9 aa, Homo sapiens
NMLYWIIYK

SEQ ID NO: 2084 - protein, 9 aa, Homo sapiens
KVASEPSLK

SEQ ID NO: 2085 - protein, 9 aa, Homo sapiens
ATLADMMPR

SEQ ID NO: 2086 - protein, 9 aa, Homo sapiens
TLADMMPRK

SEQ ID NO: 2087 - protein, 9 aa, Homo sapiens
AEATLADMM

SEQ ID NO: 2088 - protein, 9 aa, Homo sapiens
VTFEDVTVY

SEQ ID NO: 2089 - protein, 9 aa, Homo sapiens
TFEDVTVYF

SEQ ID NO: 2090 - protein, 9 aa, Homo sapiens
YLGETQFAL

SEQ ID NO: 2091 - protein, 9 aa, Homo sapiens
FALGQWAGV

SEQ ID NO: 2092 - protein, 9 aa, Homo sapiens
KSLLHQDAK

SEQ ID NO: 2093 - protein, 9 aa, Homo sapiens
GELLCAVCY

SEQ ID NO: 2094 - protein, 9 aa, Homo sapiens
HLGERMQYA

SEQ ID NO: 2095 - protein, 9 aa, Homo sapiens
GERMQYAVY

SEQ ID NO: 2096 - protein, 9 aa, Homo sapiens
AICTEYNLR

SEQ ID NO: 2097 - protein, 9 aa, Homo sapiens
QMYRRVYCL

SEQ ID NO: 2098 - protein, 9 aa, Homo sapiens
CLHERLVAI

SEQ ID NO: 2099 - protein, 9 aa, Homo sapiens
LLIDRRFSK

SEQ ID NO: 2100 - protein, 9 aa, Homo sapiens
KLPYAVSGL

SEQ ID NO: 2101 - protein, 9 aa, Homo sapiens
GQQGLFEQK

SEQ ID NO: 2102 - protein, 9 aa, Homo sapiens
QLYAGVRYL

SEQ ID NO: 2103 - protein, 9 aa, Homo sapiens
FRASGGNPI

SEQ ID NO: 2104 - protein, 9 aa, Homo sapiens
SALGSTQLL

SEQ ID NO: 2105 - protein, 9 aa, Homo sapiens
WLFGHIKEL

SEQ ID NO: 2106 - protein, 9 aa, Homo sapiens
IAVGCFCLF

SEQ ID NO: 2107 - protein, 9 aa, Homo sapiens
VGCFCLFIF

SEQ ID NO: 2108 - protein, 9 aa, Homo sapiens
IYKDWKMEK

SEQ ID NO: 2109 - protein, 9 aa, Homo sapiens
VFEVGPVCF

SEQ ID NO: 2110 - protein, 9 aa, Homo sapiens
NRTTTQEFI

SEQ ID NO: 2111 - protein, 9 aa, Homo sapiens
PFHDDFPNF

SEQ ID NO: 2112 - protein, 9 aa, Homo sapiens
FHDDFPNFM

SEQ ID NO: 2113 - protein, 9 aa, Homo sapiens
FFPVFLNCW

SEQ ID NO: 2114 - protein, 9 aa, Homo sapiens
RRKCQIRRL

SEQ ID NO: 2115 - protein, 9 aa, Homo sapiens
LHATVLNTL

SEQ ID NO: 2116 - protein, 9 aa, Homo sapiens
YMNDDPVMV

SEQ ID NO: 2117 - protein, 9 aa, Homo sapiens
TLPKALAIF

SEQ ID NO: 2118 - protein, 9 aa, Homo sapiens
ARNCCESSI

SEQ ID NO: 2119 - protein, 9 aa, Homo sapiens
TVFPMHKMI

SEQ ID NO: 2120 - protein, 9 aa, Homo sapiens
IQLFSTHFF

SEQ ID NO: 2121 - protein, 9 aa, Homo sapiens
IQLFSTHFF

SEQ ID NO: 2122 - protein, 9 aa, Homo sapiens
FYATCMYTY

SEQ ID NO: 2123 - protein, 9 aa, Homo sapiens
FYATCMYTY

SEQ ID NO: 2124 - protein, 9 aa, Homo sapiens
SRGVCVCFI

SEQ ID NO: 2125 - protein, 9 aa, Homo sapiens
KFLPGSQLL

SEQ ID NO: 2126 - protein, 9 aa, Homo sapiens
KFLPGSQLL

SEQ ID NO: 2127 - protein, 9 aa, Homo sapiens
SFSWCQAAF

SEQ ID NO: 2128 - protein, 9 aa, Homo sapiens
ERNNRTLLA

SEQ ID NO: 2129 - protein, 9 aa, Homo sapiens
AYGCNYASL

SEQ ID NO: 2130 - protein, 9 aa, Homo sapiens
AYGCNYASL

SEQ ID NO: 2131 - protein, 9 aa, Homo sapiens
WLLNEFSVF

SEQ ID NO: 2132 - protein, 9 aa, Homo sapiens
RYVAICKPI

SEQ ID NO: 2133 - protein, 9 aa, Homo sapiens
RYVAICKPI

SEQ ID NO: 2134 - protein, 9 aa, Homo sapiens
QVFLWRTNF

SEQ ID NO: 2135 - protein, 9 aa, Homo sapiens
QYQKTKVTI

SEQ ID NO: 2136 - protein, 9 aa, Homo sapiens
QYQKTKVTI

SEQ ID NO: 2137 - protein, 9 aa, Homo sapiens
SFPRWRYYF

SEQ ID NO: 2138 - protein, 9 aa, Homo sapiens
PRWRYYFYF

SEQ ID NO: 2139 - protein, 9 aa, Homo sapiens
RWRYYFYFI

SEQ ID NO: 2140 - protein, 9 aa, Homo sapiens
RYYFYFITL

SEQ ID NO: 2141 - protein, 9 aa, Homo sapiens
YYFYFITLI

SEQ ID NO: 2142 - protein, 9 aa, Homo sapiens
SFPRWRYYF

SEQ ID NO: 2143 - protein, 9 aa, Homo sapiens
RWRYYFYFI

SEQ ID NO: 2144 - protein, 9 aa, Homo sapiens
RYYFYFITL

SEQ ID NO: 2145 - protein, 9 aa, Homo sapiens
YYFYFITLI

SEQ ID NO: 2146 - protein, 9 aa, Homo sapiens
YYFYFITLI

SEQ ID NO: 2147 - protein, 9 aa, Homo sapiens
YLQKQLERF

SEQ ID NO: 2148 - protein, 9 aa, Homo sapiens
TYPACGRGF

SEQ ID NO: 2149 - protein, 9 aa, Homo sapiens
TYPACGRGF

SEQ ID NO: 2150 - protein, 9 aa, Homo sapiens
TYYYRSDIW

SEQ ID NO: 2151 - protein, 9 aa, Homo sapiens
YYRSDIWSL

SEQ ID NO: 2152 - protein, 9 aa, Homo sapiens
TYYYRSDIW

SEQ ID NO: 2153 - protein, 9 aa, Homo sapiens
YYRSDIWSL

SEQ ID NO: 2154 - protein, 9 aa, Homo sapiens
YYRSDIWSL

SEQ ID NO: 2155 - protein, 9 aa, Homo sapiens
SFQTVSAFF

SEQ ID NO: 2156 - protein, 9 aa, Homo sapiens
SFQTVSAFF

SEQ ID NO: 2157 - protein, 9 aa, Homo sapiens
FFRENLNKL

SEQ ID NO: 2158 - protein, 9 aa, Homo sapiens
YYDDTHPSM

SEQ ID NO: 2159 - protein, 9 aa, Homo sapiens
THPSMKEQM

SEQ ID NO: 2160 - protein, 9 aa, Homo sapiens
TYMSCLKSL

SEQ ID NO: 2161 - protein, 9 aa, Homo sapiens
TYMSCLKSL

SEQ ID NO: 2162 - protein, 9 aa, Homo sapiens
TYMSCLKSL

SEQ ID NO: 2163 - protein, 9 aa, Homo sapiens
AHPNIAKLV

SEQ ID NO: 2164 - protein, 9 aa, Homo sapiens
MTASAWASW

SEQ ID NO: 2165 - protein, 9 aa, Homo sapiens
DHYYPLPYI

SEQ ID NO: 2166 - protein, 9 aa, Homo sapiens
FREMDDNQV

SEQ ID NO: 2167 - protein, 9 aa, Homo sapiens
PHACIIELL

SEQ ID NO: 2168 - protein, 9 aa, Homo sapiens
RRGRRPSDI

SEQ ID NO: 2169 - protein, 9 aa, Homo sapiens
LRKNHNFDI

SEQ ID NO: 2170 - protein, 9 aa, Homo sapiens
NHNFDICTL

SEQ ID NO: 2171 - protein, 9 aa, Homo sapiens
FDTARQEYL

SEQ ID NO: 2172 - protein, 9 aa, Homo sapiens
YRRGREEAT

SEQ ID NO: 2173 - protein, 9 aa, Homo sapiens
GREEATYLL

SEQ ID NO: 2174 - protein, 9 aa, Homo sapiens
IHNFRAKNV

SEQ ID NO: 2175 - protein, 9 aa, Homo sapiens
FRAKNVSPM

SEQ ID NO: 2176 - protein, 9 aa, Homo sapiens
SRLSDSFSL

SEQ ID NO: 2177 - protein, 9 aa, Homo sapiens
LFLVAGHEL

SEQ ID NO: 2178 - protein, 9 aa, Homo sapiens
DRPQVVNVL

SEQ ID NO: 2179 - protein, 9 aa, Homo sapiens
LYHSNSPCW

SEQ ID NO: 2180 - protein, 9 aa, Homo sapiens
LYHSNSPCW

SEQ ID NO: 2181 - protein, 9 aa, Homo sapiens
VYQEVEEHK

SEQ ID NO: 2182 - protein, 9 aa, Homo sapiens
LYCAIKQQI

SEQ ID NO: 2183 - protein, 9 aa, Homo sapiens
LYCAIKQQI

SEQ ID NO: 2184 - protein, 9 aa, Homo sapiens
FRQFANLYV

SEQ ID NO: 2185 - protein, 9 aa, Homo sapiens
VRASVPQRL

SEQ ID NO: 2186 - protein, 9 aa, Homo sapiens
WLMGNSWNF

SEQ ID NO: 2187 - protein, 9 aa, Homo sapiens
MGNSWNFKF

SEQ ID NO: 2188 - protein, 9 aa, Homo sapiens
WLMGNSWNF

SEQ ID NO: 2189 - protein, 9 aa, Homo sapiens
TKSEREQEI

SEQ ID NO: 2190 - protein, 9 aa, Homo sapiens
DRGDRSLKY

SEQ ID NO: 2191 - protein, 9 aa, Homo sapiens
TANNNIPTI

SEQ ID NO: 2192 - protein, 9 aa, Homo sapiens
DVYEHQLIL

SEQ ID NO: 2193 - protein, 9 aa, Homo sapiens
EHKMYSMEV

SEQ ID NO: 2194 - protein, 9 aa, Homo sapiens
WRTTIPALL

SEQ ID NO: 2195 - protein, 9 aa, Homo sapiens
AHLQSIQTL

SEQ ID NO: 2196 - protein, 9 aa, Homo sapiens
NKKEREEYV

SEQ ID NO: 2197 - protein, 9 aa, Homo sapiens
SRSNVTLPV

SEQ ID NO: 2198 - protein, 9 aa, Homo sapiens
DRITRSHAV

SEQ ID NO: 2199 - protein, 9 aa, Homo sapiens
VFIFRYLKL

SEQ ID NO: 2200 - protein, 9 aa, Homo sapiens
VFIFRYLKL

SEQ ID NO: 2201 - protein, 9 aa, Homo sapiens
FRTRFMSLI

SEQ ID NO: 2202 - protein, 9 aa, Homo sapiens
FVVAVHYCF

SEQ ID NO: 2203 - protein, 9 aa, Homo sapiens
LFGFVASIF

SEQ ID NO: 2204 - protein, 9 aa, Homo sapiens
LFGFVASIF

SEQ ID NO: 2205 - protein, 9 aa, Homo sapiens
NLYDNVNKL

SEQ ID NO: 2206 - protein, 9 aa, Homo sapiens
SYAYTAPEL

SEQ ID NO: 2207 - protein, 9 aa, Homo sapiens
YHYPNAGSE

SEQ ID NO: 2208 - protein, 9 aa, Homo sapiens
LTYLTNSLF

SEQ ID NO: 2209 - protein, 9 aa, Homo sapiens
IWVPLSVIL

SEQ ID NO: 2210 - protein, 9 aa, Homo sapiens
SQYSVNSEL

SEQ ID NO: 2211 - protein, 9 aa, Homo sapiens
HIYAMGLVF

SEQ ID NO: 2212 - protein, 9 aa, Homo sapiens
FKRAHIYAM

SEQ ID NO: 2213 - protein, 9 aa, Homo sapiens
FFADEFLRL

SEQ ID NO: 2214 - protein, 9 aa, Homo sapiens
FADEFLRLL

SEQ ID NO: 2215 - protein, 9 aa, Homo sapiens
GHFARDSPV

SEQ ID NO: 2216 - protein, 9 aa, Homo sapiens
SHVDLVKDF

SEQ ID NO: 2217 - protein, 9 aa, Homo sapiens
ALLLGCALA

SEQ ID NO: 2218 - protein, 9 aa, Homo sapiens
LLLGCALAA

SEQ ID NO: 2219 - protein, 9 aa, Homo sapiens
LLGCALAAA

SEQ ID NO: 2220 - protein, 9 aa, Homo sapiens
ARACFALLL

SEQ ID NO: 2221 - protein, 9 aa, Homo sapiens
ARACFALLL

SEQ ID NO: 2222 - protein, 9 aa, Homo sapiens
SRAAERLQV

SEQ ID NO: 2223 - protein, 9 aa, Homo sapiens
YLCAVGQTA

SEQ ID NO: 2224 - protein, 9 aa, Homo sapiens
HQFYVGAAK

SEQ ID NO: 2225 - protein, 9 aa, Homo sapiens
HQFYVGAAK

SEQ ID NO: 2226 - protein, 9 aa, Homo sapiens
NLSDSNFVM

SEQ ID NO: 2227 - protein, 9 aa, Homo sapiens
AHRDWNHRI

SEQ ID NO: 2228 - protein, 9 aa, Homo sapiens
NHRIDPTVL

SEQ ID NO: 2229 - protein, 9 aa, Homo sapiens
WVGPDDWLV

SEQ ID NO: 2230 - protein, 9 aa, Homo sapiens
RRGSMNNQL

SEQ ID NO: 2231 - protein, 9 aa, Homo sapiens
RRGSMNNQL

SEQ ID NO: 2232 - protein, 9 aa, Homo sapiens
FRRILNVPK

SEQ ID NO: 2233 - protein, 9 aa, Homo sapiens
RRILNVPKA

SEQ ID NO: 2234 - protein, 9 aa, Homo sapiens
MLSELSIII

SEQ ID NO: 2235 - protein, 9 aa, Homo sapiens
IIFDGNNAA

SEQ ID NO: 2236 - protein, 9 aa, Homo sapiens
GMGPLLAMV

SEQ ID NO: 2237 - protein, 9 aa, Homo sapiens
MVSGASTGV

SEQ ID NO: 2238 - protein, 9 aa, Homo sapiens
LREDQLSPV

SEQ ID NO: 2239 - protein, 9 aa, Homo sapiens
FMHPEPGHV

SEQ ID NO: 2240 - protein, 9 aa, Homo sapiens
MHPEPGHVL

SEQ ID NO: 2241 - protein, 9 aa, Homo sapiens
LQLTAYYVL

SEQ ID NO: 2242 - protein, 9 aa, Homo sapiens
YVLTWIVGA

SEQ ID NO: 2243 - protein, 9 aa, Homo sapiens
VLTWIVGAK

SEQ ID NO: 2244 - protein, 9 aa, Homo sapiens
WLLWVVAAA

SEQ ID NO: 2245 - protein, 9 aa, Homo sapiens
SLRNLPTSV

SEQ ID NO: 2246 - protein, 9 aa, Homo sapiens
HRLYSLRNL

SEQ ID NO: 2247 - protein, 9 aa, Homo sapiens
LRNLPTSVL

SEQ ID NO: 2248 - protein, 9 aa, Homo sapiens
CRILKAYTI

SEQ ID NO: 2249 - protein, 9 aa, Homo sapiens
LLVALTRPA

SEQ ID NO: 2250 - protein, 9 aa, Homo sapiens
RLLLVALTR

SEQ ID NO: 2251 - protein, 9 aa, Homo sapiens
FRWQWHEVG

SEQ ID NO: 2252 - protein, 9 aa, Homo sapiens
WHEVGAPYL

SEQ ID NO: 2253 - protein, 9 aa, Homo sapiens
GRGGLGPPV

SEQ ID NO: 2254 - protein, 9 aa, Homo sapiens
QMAPSLTFK

SEQ ID NO: 2255 - protein, 9 aa, Homo sapiens
GLVHVGHEL

SEQ ID NO: 2256 - protein, 9 aa, Homo sapiens
RSFLGLGPR

SEQ ID NO: 2257 - protein, 9 aa, Homo sapiens
VLHCIAGCV

SEQ ID NO: 2258 - protein, 9 aa, Homo sapiens
ERFDTTLCV

SEQ ID NO: 2259 - protein, 9 aa, Homo sapiens
KIFCASTRL

SEQ ID NO: 2260 - protein, 9 aa, Homo sapiens
FHAARTLLP

SEQ ID NO: 2261 - protein, 9 aa, Homo sapiens
GLLSLPMAT

SEQ ID NO: 2262 - protein, 9 aa, Homo sapiens
YQFAKVGIL

SEQ ID NO: 2263 - protein, 9 aa, Homo sapiens
YQFAKVGIL

SEQ ID NO: 2264 - protein, 9 aa, Homo sapiens
MTPWLGFIV

SEQ ID NO: 2265 - protein, 9 aa, Homo sapiens
YSANNTSEL

SEQ ID NO: 2266 - protein, 9 aa, Homo sapiens
SANNTSELL

SEQ ID NO: 2267 - protein, 9 aa, Homo sapiens
KRTEQDETI

SEQ ID NO: 2268 - protein, 9 aa, Homo sapiens
GIFEFCWNA

SEQ ID NO: 2269 - protein, 9 aa, Homo sapiens
RQLCDLRLF

SEQ ID NO: 2270 - protein, 9 aa, Homo sapiens
EFFDETRQL

SEQ ID NO: 2271 - protein, 9 aa, Homo sapiens
TRQLCDLRL

SEQ ID NO: 2272 - protein, 9 aa, Homo sapiens
LLTGHNASL

SEQ ID NO: 2273 - protein, 9 aa, Homo sapiens
SRAASVGHY

SEQ ID NO: 2274 - protein, 9 aa, Homo sapiens
ARTMQTARK

SEQ ID NO: 2275 - protein, 9 aa, Homo sapiens
LVLLVHARV

SEQ ID NO: 2276 - protein, 9 aa, Homo sapiens
WLLALSPNL

SEQ ID NO: 2277 - protein, 9 aa, Homo sapiens
NLSLSNATV

SEQ ID NO: 2278 - protein, 9 aa, Homo sapiens
CRIADCRLL

SEQ ID NO: 2279 - protein, 9 aa, Homo sapiens
KLFCHIAGM

SEQ ID NO: 2280 - protein, 9 aa, Homo sapiens
CLAVNEWFV

SEQ ID NO: 2281 - protein, 9 aa, Homo sapiens
MSFDHYIAL

SEQ ID NO: 2282 - protein, 9 aa, Homo sapiens
MSFDHYIAL

SEQ ID NO: 2283 - protein, 9 aa, Homo sapiens
RISIVALFV

SEQ ID NO: 2284 - protein, 9 aa, Homo sapiens
HRISIVALF

SEQ ID NO: 2285 - protein, 9 aa, Homo sapiens
VSPKHRLIK

SEQ ID NO: 2286 - protein, 9 aa, Homo sapiens
VRYVSPKHR

SEQ ID NO: 2287 - protein, 9 aa, Homo sapiens
YVSPKHRLI

SEQ ID NO: 2288 - protein, 9 aa, Homo sapiens
GLLAGTLAV

SEQ ID NO: 2289 - protein, 9 aa, Homo sapiens
LLAGTLAVV

SEQ ID NO: 2290 - protein, 9 aa, Homo sapiens
MHQSMTQQR

SEQ ID NO: 2291 - protein, 9 aa, Homo sapiens
TRQPVVTLL

SEQ ID NO: 2292 - protein, 9 aa, Homo sapiens
ETRQPVVTL

SEQ ID NO: 2293 - protein, 9 aa, Homo sapiens
RALLCTPAL

SEQ ID NO: 2294 - protein, 9 aa, Homo sapiens
RALLCTPAL

SEQ ID NO: 2295 - protein, 9 aa, Homo sapiens
KADVLHVVV

SEQ ID NO: 2296 - protein, 9 aa, Homo sapiens
RLHEEAHLL

SEQ ID NO: 2297 - protein, 9 aa, Homo sapiens
GASGGWQHL

SEQ ID NO: 2298 - protein, 9 aa, Homo sapiens
GASGGWQHL

SEQ ID NO: 2299 - protein, 9 aa, Homo sapiens
FAFLSVEDL

SEQ ID NO: 2300 - protein, 9 aa, Homo sapiens
FAFLSVEDL

SEQ ID NO: 2301 - protein, 9 aa, Homo sapiens
AAAVVAQEI

SEQ ID NO: 2302 - protein, 9 aa, Homo sapiens
AVVAQEIQM

SEQ ID NO: 2303 - protein, 9 aa, Homo sapiens
KSPPTAAAV

SEQ ID NO: 2304 - protein, 9 aa, Homo sapiens
ALLPAAVVM

SEQ ID NO: 2305 - protein, 9 aa, Homo sapiens
VVMPPQPVV

SEQ ID NO: 2306 - protein, 9 aa, Homo sapiens
YALLPAAVV

SEQ ID NO: 2307 - protein, 9 aa, Homo sapiens
ALLPAAVVM

SEQ ID NO: 2308 - protein, 9 aa, Homo sapiens
AVVMPPQPV

SEQ ID NO: 2309 - protein, 9 aa, Homo sapiens
VVMPPQPVV

SEQ ID NO: 2310 - protein, 9 aa, Homo sapiens
YALLPAAVV

SEQ ID NO: 2311 - protein, 9 aa, Homo sapiens
VVMPPQPVV

SEQ ID NO: 2312 - protein, 9 aa, Homo sapiens
GLFALLSNT

SEQ ID NO: 2313 - protein, 9 aa, Homo sapiens
FALLSNTGF

SEQ ID NO: 2314 - protein, 9 aa, Homo sapiens
FALLSNTGF

SEQ ID NO: 2315 - protein, 9 aa, Homo sapiens
GSLSAELGL

SEQ ID NO: 2316 - protein, 9 aa, Homo sapiens
LSAELGLEI

SEQ ID NO: 2317 - protein, 9 aa, Homo sapiens
LVVVGACGV

SEQ ID NO: 2318 - protein, 9 aa, Homo sapiens
IVVHCVNEV

SEQ ID NO: 2319 - protein, 9 aa, Homo sapiens
IVVHCVNEV

SEQ ID NO: 2320 - protein, 9 aa, Homo sapiens
ELLDRGCPL

SEQ ID NO: 2321 - protein, 9 aa, Homo sapiens
EIAQAYISL

SEQ ID NO: 2322 - protein, 9 aa, Homo sapiens
EIAQAYISL

SEQ ID NO: 2323 - protein, 9 aa, Homo sapiens
ISLKETNRL

SEQ ID NO: 2324 - protein, 9 aa, Homo sapiens
ISLKETNRL

SEQ ID NO: 2325 - protein, 9 aa, Homo sapiens
DTVSSTMYL

SEQ ID NO: 2326 - protein, 9 aa, Homo sapiens
AVNGVIFQL

SEQ ID NO: 2327 - protein, 9 aa, Homo sapiens
MAAPLRRLL

SEQ ID NO: 2328 - protein, 9 aa, Homo sapiens
MAAPLRRLL

SEQ ID NO: 2329 - protein, 9 aa, Homo sapiens
SLTAEQLSL

SEQ ID NO: 2330 - protein, 9 aa, Homo sapiens
EGVFAVASL

SEQ ID NO: 2331 - protein, 9 aa, Homo sapiens
FAVASLTAE

SEQ ID NO: 2332 - protein, 9 aa, Homo sapiens
VASLTAEQL

SEQ ID NO: 2333 - protein, 9 aa, Homo sapiens
LLLLTLLLL

SEQ ID NO: 2334 - protein, 9 aa, Homo sapiens
LLTLLLLGL

SEQ ID NO: 2335 - protein, 9 aa, Homo sapiens
YVRFYQHLV

SEQ ID NO: 2336 - protein, 9 aa, Homo sapiens
YVRFYQHLV

SEQ ID NO: 2337 - protein, 9 aa, Homo sapiens
EASDLLERI

SEQ ID NO: 2338 - protein, 9 aa, Homo sapiens
CPLPGTSVY

SEQ ID NO: 2339 - protein, 9 aa, Homo sapiens
KGYHQFVLM

SEQ ID NO: 2340 - protein, 9 aa, Homo sapiens
LALRREKVL

SEQ ID NO: 2341 - protein, 9 aa, Homo sapiens
LALRREKVL

SEQ ID NO: 2342 - protein, 9 aa, Homo sapiens
GRDSCEAVL

SEQ ID NO: 2343 - protein, 9 aa, Homo sapiens
DSCEAVLTV

SEQ ID NO: 2344 - protein, 9 aa, Homo sapiens
TICAFVFLA

SEQ ID NO: 2345 - protein, 9 aa, Homo sapiens
FVFLAALFL

SEQ ID NO: 2346 - protein, 9 aa, Homo sapiens
CTICAFVFL

SEQ ID NO: 2347 - protein, 9 aa, Homo sapiens
CAFVFLAAL

SEQ ID NO: 2348 - protein, 9 aa, Homo sapiens
FVFLAALFL

SEQ ID NO: 2349 - protein, 9 aa, Homo sapiens
CAFVFLAAL

SEQ ID NO: 2350 - protein, 9 aa, Homo sapiens
FVFLAALFL

SEQ ID NO: 2351 - protein, 9 aa, Homo sapiens
STSGRLCPL

SEQ ID NO: 2352 - protein, 9 aa, Homo sapiens
TNFLSFGPL

SEQ ID NO: 2353 - protein, 9 aa, Homo sapiens
IQTEIRKAV

SEQ ID NO: 2354 - protein, 9 aa, Homo sapiens
VPQDWVGPL

SEQ ID NO: 2355 - protein, 9 aa, Homo sapiens
GVAYVSVLV

SEQ ID NO: 2356 - protein, 9 aa, Homo sapiens
VGVAYVSVL

SEQ ID NO: 2357 - protein, 9 aa, Homo sapiens
VAYVSVLVT

SEQ ID NO: 2358 - protein, 9 aa, Homo sapiens
VAYVSVLVT

SEQ ID NO: 2359 - protein, 9 aa, Homo sapiens
FEGPRVIDL

SEQ ID NO: 2360 - protein, 9 aa, Homo sapiens
AEFEGPRVI

SEQ ID NO: 2361 - protein, 9 aa, Homo sapiens
MFYNRYPYV

SEQ ID NO: 2362 - protein, 9 aa, Homo sapiens
DMFYNRYPY

SEQ ID NO: 2363 - protein, 9 aa, Homo sapiens
MFYNRYPYV

SEQ ID NO: 2364 - protein, 9 aa, Homo sapiens
QGFETLKQI

SEQ ID NO: 2365 - protein, 9 aa, Homo sapiens
DTHQGYARV

SEQ ID NO: 2366 - protein, 9 aa, Homo sapiens
DTHQGYARV

SEQ ID NO: 2367 - protein, 9 aa, Homo sapiens
PALICPLNL

SEQ ID NO: 2368 - protein, 9 aa, Homo sapiens
KRFENEIIL

SEQ ID NO: 2369 - protein, 9 aa, Homo sapiens
CVTKPTETI

SEQ ID NO: 2370 - protein, 9 aa, Homo sapiens
KATRVPDIL

SEQ ID NO: 2371 - protein, 9 aa, Homo sapiens
RLLRVPSSA

SEQ ID NO: 2372 - protein, 9 aa, Homo sapiens
FAVAHGATT

SEQ ID NO: 2373 - protein, 9 aa, Homo sapiens
FAVAHGATT

SEQ ID NO: 2374 - protein, 9 aa, Homo sapiens
MARMNVAQL

SEQ ID NO: 2375 - protein, 9 aa, Homo sapiens
MARMNVAQL

SEQ ID NO: 2376 - protein, 9 aa, Homo sapiens
QLMYGRMPA

SEQ ID NO: 2377 - protein, 9 aa, Homo sapiens
LMYGRMPAA

SEQ ID NO: 2378 - protein, 9 aa, Homo sapiens
SQAQYGAVV

SEQ ID NO: 2379 - protein, 9 aa, Homo sapiens
AQYGAVVTA

SEQ ID NO: 2380 - protein, 9 aa, Homo sapiens
ASRQRTRFV

SEQ ID NO: 2381 - protein, 9 aa, Homo sapiens
RQRTRFVRR

SEQ ID NO: 2382 - protein, 9 aa, Homo sapiens
RTRFVRRSL

SEQ ID NO: 2383 - protein, 9 aa, Homo sapiens
FVRRSLSPV

SEQ ID NO: 2384 - protein, 9 aa, Homo sapiens
ASRQRTRFV

SEQ ID NO: 2385 - protein, 9 aa, Homo sapiens
TRFVRRSLS

SEQ ID NO: 2386 - protein, 9 aa, Homo sapiens
LLFDCPTWA

SEQ ID NO: 2387 - protein, 9 aa, Homo sapiens
FLIGESEST

SEQ ID NO: 2388 - protein, 9 aa, Homo sapiens
GSKSSDDHK

SEQ ID NO: 2389 - protein, 9 aa, Homo sapiens
FRWEQVVDL

SEQ ID NO: 2390 - protein, 9 aa, Homo sapiens
VQYEPWAAL

SEQ ID NO: 2391 - protein, 9 aa, Homo sapiens
CHSNQRGEL

SEQ ID NO: 2392 - protein, 9 aa, Homo sapiens
MYRGFVFSL

SEQ ID NO: 2393 - protein, 9 aa, Homo sapiens
FLNDLLSVL

SEQ ID NO: 2394 - protein, 9 aa, Homo sapiens
KANWYFLFA

SEQ ID NO: 2395 - protein, 9 aa, Homo sapiens
KFKEMVFSL

SEQ ID NO: 2396 - protein, 9 aa, Homo sapiens
KEMVFSLFK

SEQ ID NO: 2397 - protein, 9 aa, Homo sapiens
MVFSLFKAK

SEQ ID NO: 2398 - protein, 9 aa, Homo sapiens
LLGQRIARL

SEQ ID NO: 2399 - protein, 9 aa, Homo sapiens
GQRIARLLV

SEQ ID NO: 2400 - protein, 9 aa, Homo sapiens
FLDRTVDRL

SEQ ID NO: 2401 - protein, 9 aa, Homo sapiens
AELEEQKRF

SEQ ID NO: 2402 - protein, 9 aa, Homo sapiens
QLVDYQSFA

SEQ ID NO: 2403 - protein, 9 aa, Homo sapiens
LVDYQSFAV

SEQ ID NO: 2404 - protein, 9 aa, Homo sapiens
TRDDGTQLV

SEQ ID NO: 2405 - protein, 9 aa, Homo sapiens
GICDILLAL

SEQ ID NO: 2406 - protein, 9 aa, Homo sapiens
VHRRYSALK

SEQ ID NO: 2407 - protein, 9 aa, Homo sapiens
TTRQITGHR

SEQ ID NO: 2408 - protein, 9 aa, Homo sapiens
HRAVYENEL

SEQ ID NO: 2409 - protein, 9 aa, Homo sapiens
VIFYNCSFL

SEQ ID NO: 2410 - protein, 9 aa, Homo sapiens
IFYNCSFLV

SEQ ID NO: 2411 - protein, 9 aa, Homo sapiens
FLVLDLQRI

SEQ ID NO: 2412 - protein, 9 aa, Homo sapiens
MIISHLYLI

SEQ ID NO: 2413 - protein, 9 aa, Homo sapiens
HLYLIHILL

SEQ ID NO: 2414 - protein, 9 aa, Homo sapiens
YLIHILLLF

SEQ ID NO: 2415 - protein, 9 aa, Homo sapiens
ISHLYLIHI

SEQ ID NO: 2416 - protein, 9 aa, Homo sapiens
SHLYLIHIL

SEQ ID NO: 2417 - protein, 9 aa, Homo sapiens
VLNPFIYML

SEQ ID NO: 2418 - protein, 9 aa, Homo sapiens
YMFLASPSV

SEQ ID NO: 2419 - protein, 9 aa, Homo sapiens
FLASPSVPL

SEQ ID NO: 2420 - protein, 9 aa, Homo sapiens
KLFEQILNA

SEQ ID NO: 2421 - protein, 9 aa, Homo sapiens
KLFEQILNA

SEQ ID NO: 2422 - protein, 9 aa, Homo sapiens
FEQILNAEY

SEQ ID NO: 2423 - protein, 9 aa, Homo sapiens
SLNSSDPDV

SEQ ID NO: 2424 - protein, 9 aa, Homo sapiens
KEIWDSFKV

SEQ ID NO: 2425 - protein, 9 aa, Homo sapiens
VLRAELQIK

SEQ ID NO: 2426 - protein, 9 aa, Homo sapiens
AELQIKDNL

SEQ ID NO: 2427 - protein, 9 aa, Homo sapiens
GARGTLLLA

SEQ ID NO: 2428 - protein, 9 aa, Homo sapiens
ARSGARGTL

SEQ ID NO: 2429 - protein, 9 aa, Homo sapiens
KSRESLDKQ

SEQ ID NO: 2430 - protein, 9 aa, Homo sapiens
NRPKSRESL

SEQ ID NO: 2431 - protein, 9 aa, Homo sapiens
EEGQWSDDF

SEQ ID NO: 2432 - protein, 9 aa, Homo sapiens
IMCKKMFEV

SEQ ID NO: 2433 - protein, 9 aa, Homo sapiens
KAEDSWPSI

SEQ ID NO: 2434 - protein, 9 aa, Homo sapiens
KMFNLRTKI

SEQ ID NO: 2435 - protein, 9 aa, Homo sapiens
MAKMFNLRT

SEQ ID NO: 2436 - protein, 9 aa, Homo sapiens
RFRSTFDTL

SEQ ID NO: 2437 - protein, 9 aa, Homo sapiens
RSTFDTLRK

SEQ ID NO: 2438 - protein, 9 aa, Homo sapiens
RVNHFRDML

SEQ ID NO: 2439 - protein, 9 aa, Homo sapiens
ERVNHFRDM

SEQ ID NO: 2440 - protein, 9 aa, Homo sapiens
GMYVSAQPL

SEQ ID NO: 2441 - protein, 9 aa, Homo sapiens
MYVSAQPLA

SEQ ID NO: 2442 - protein, 9 aa, Homo sapiens
ALVRTPLHK

SEQ ID NO: 2443 - protein, 9 aa, Homo sapiens
LARRKGGLA

SEQ ID NO: 2444 - protein, 9 aa, Homo sapiens
TLFTMVGTV

SEQ ID NO: 2445 - protein, 9 aa, Homo sapiens
FTMVGTVAL

SEQ ID NO: 2446 - protein, 9 aa, Homo sapiens
SLIFLTFLT

SEQ ID NO: 2447 - protein, 9 aa, Homo sapiens
TEIQSLIFL

SEQ ID NO: 2448 - protein, 9 aa, Homo sapiens
SLDGKTIKV

SEQ ID NO: 2449 - protein, 9 aa, Homo sapiens
KSLDGKTIK

SEQ ID NO: 2450 - protein, 9 aa, Homo sapiens
TIKVAQATK

SEQ ID NO: 2451 - protein, 9 aa, Homo sapiens
GHNEINHLF

SEQ ID NO: 2452 - protein, 9 aa, Homo sapiens
GINAINLPL

SEQ ID NO: 2453 - protein, 9 aa, Homo sapiens
AMNELLHDL

SEQ ID NO: 2454 - protein, 9 aa, Homo sapiens
RSLLHRVRR

SEQ ID NO: 2455 - protein, 9 aa, Homo sapiens
SLKCRPPER

SEQ ID NO: 2456 - protein, 9 aa, Homo sapiens
KWKAFSACG

SEQ ID NO: 2457 - protein, 9 aa, Homo sapiens
AVLPLGARV

SEQ ID NO: 2458 - protein, 9 aa, Homo sapiens
WLWEPLRVV

SEQ ID NO: 2459 - protein, 9 aa, Homo sapiens
TLYVTLASL

SEQ ID NO: 2460 - protein, 9 aa, Homo sapiens
RESCAHDEF

SEQ ID NO: 2461 - protein, 9 aa, Homo sapiens
KSKRQKMER

SEQ ID NO: 2462 - protein, 9 aa, Homo sapiens
RQKMERMLL

SEQ ID NO: 2463 - protein, 9 aa, Homo sapiens
KRQKMERML

SEQ ID NO: 2464 - protein, 9 aa, Homo sapiens
PEACGGLAY

SEQ ID NO: 2465 - protein, 9 aa, Homo sapiens
RIHVRPSHA

SEQ ID NO: 2466 - protein, 9 aa, Homo sapiens
HVRPSHANT

SEQ ID NO: 2467 - protein, 9 aa, Homo sapiens
VRPSHANTL

SEQ ID NO: 2468 - protein, 9 aa, Homo sapiens
HQRTHTGGK

SEQ ID NO: 2469 - protein, 9 aa, Homo sapiens
RTHTGGKPY

SEQ ID NO: 2470 - protein, 9 aa, Homo sapiens
THTGGKPYV

SEQ ID NO: 2471 - protein, 9 aa, Homo sapiens
RTGSKTPQA

SEQ ID NO: 2472 - protein, 9 aa, Homo sapiens
GSKTPQAPM

SEQ ID NO: 2473 - protein, 9 aa, Homo sapiens
AIKKTMAQA

SEQ ID NO: 2474 - protein, 9 aa, Homo sapiens
ILHNAEPRV

SEQ ID NO: 2475 - protein, 9 aa, Homo sapiens
ALEPGKPLV

SEQ ID NO: 2476 - protein, 9 aa, Homo sapiens
GMALCPPQA

SEQ ID NO: 2477 - protein, 9 aa, Homo sapiens
QARKRALEA

SEQ ID NO: 2478 - protein, 9 aa, Homo sapiens
CVISVLYQV

SEQ ID NO: 2479 - protein, 9 aa, Homo sapiens
YQVGLMQWV

SEQ ID NO: 2480 - protein, 9 aa, Homo sapiens
HLFPKFYPC

SEQ ID NO: 2481 - protein, 9 aa, Homo sapiens
AQFIHLFPK

SEQ ID NO: 2482 - protein, 9 aa, Homo sapiens
AGRNSSSPK

SEQ ID NO: 2483 - protein, 9 aa, Homo sapiens
RVRFAPSPI

SEQ ID NO: 2484 - protein, 9 aa, Homo sapiens
MLCVLELLL

SEQ ID NO: 2485 - protein, 9 aa, Homo sapiens
ASYYHRPEA

SEQ ID NO: 2486 - protein, 9 aa, Homo sapiens
EEIASYYHR

SEQ ID NO: 2487 - protein, 9 aa, Homo sapiens
RWRRRRPGG

SEQ ID NO: 2488 - protein, 9 aa, Homo sapiens
SLSSGTASL

SEQ ID NO: 2489 - protein, 9 aa, Homo sapiens
KQAHEVFSV

SEQ ID NO: 2490 - protein, 9 aa, Homo sapiens
TMAAISNTV

SEQ ID NO: 2491 - protein, 9 aa, Homo sapiens
ALSYTPAEV

SEQ ID NO: 2492 - protein, 9 aa, Homo sapiens
SELEHLTFI

SEQ ID NO: 2493 - protein, 9 aa, Homo sapiens
ASRRVTWNV

SEQ ID NO: 2494 - protein, 9 aa, Homo sapiens
LTRADLSSI

SEQ ID NO: 2495 - protein, 9 aa, Homo sapiens
HLYSRIPCL

SEQ ID NO: 2496 - protein, 9 aa, Homo sapiens
CLLSPHPLL

SEQ ID NO: 2497 - protein, 9 aa, Homo sapiens
FLTVFSHFM

SEQ ID NO: 2498 - protein, 9 aa, Homo sapiens
SHFMMGALM

SEQ ID NO: 2499 - protein, 9 aa, Homo sapiens
RAFTTKCNL

SEQ ID NO: 2500 - protein, 9 aa, Homo sapiens
MLRATLLKV

SEQ ID NO: 2501 - protein, 9 aa, Homo sapiens
MLRATLLKV

SEQ ID NO: 2502 - protein, 9 aa, Homo sapiens
RTKDIYRVN

SEQ ID NO: 2503 - protein, 9 aa, Homo sapiens
HHRTRLRQI

SEQ ID NO: 2504 - protein, 9 aa, Homo sapiens
ELLEAQDQV

SEQ ID NO: 2505 - protein, 9 aa, Homo sapiens
ITLSRSPPR

SEQ ID NO: 2506 - protein, 9 aa, Homo sapiens
SETSITLSR

SEQ ID NO: 2507 - protein, 9 aa, Homo sapiens
RTSSSSSFT

SEQ ID NO: 2508 - protein, 9 aa, Homo sapiens
FIEAWLEKL

SEQ ID NO: 2509 - protein, 9 aa, Homo sapiens
ILAAGKYKL

SEQ ID NO: 2510 - protein, 9 aa, Homo sapiens
KILAAGKYK

SEQ ID NO: 2511 - protein, 9 aa, Homo sapiens
KSLPPPFIA

SEQ ID NO: 2512 - protein, 9 aa, Homo sapiens
RLLRQSPLY

SEQ ID NO: 2513 - protein, 9 aa, Homo sapiens
LTSEDVDYV

SEQ ID NO: 2514 - protein, 9 aa, Homo sapiens
FLRIPFLHL

SEQ ID NO: 2515 - protein, 9 aa, Homo sapiens
FLHLLLFTS

SEQ ID NO: 2516 - protein, 9 aa, Homo sapiens
GSFLRIPFL

SEQ ID NO: 2517 - protein, 9 aa, Homo sapiens
LRIPFLHLL

SEQ ID NO: 2518 - protein, 9 aa, Homo sapiens
SFRLSRGGR

SEQ ID NO: 2519 - protein, 9 aa, Homo sapiens
RLSRGGRPA

SEQ ID NO: 2520 - protein, 9 aa, Homo sapiens
GVRFPVPGG

SEQ ID NO: 2521 - protein, 9 aa, Homo sapiens
LLSESNECL

SEQ ID NO: 2522 - protein, 9 aa, Homo sapiens
SESNECLQL

SEQ ID NO: 2523 - protein, 9 aa, Homo sapiens
RVPYVIVSA

SEQ ID NO: 2524 - protein, 9 aa, Homo sapiens
LMFWASSSI

SEQ ID NO: 2525 - protein, 9 aa, Homo sapiens
KVFNQKRNL

SEQ ID NO: 2526 - protein, 9 aa, Homo sapiens
GLRYPNCKL

SEQ ID NO: 2527 - protein, 9 aa, Homo sapiens
FVPCMAAFA

SEQ ID NO: 2528 - protein, 9 aa, Homo sapiens
GASRRRVGK

SEQ ID NO: 2529 - protein, 9 aa, Homo sapiens
SRRRVGKPK

SEQ ID NO: 2530 - protein, 9 aa, Homo sapiens
RRRVGKPKA

SEQ ID NO: 2531 - protein, 9 aa, Homo sapiens
YSFRHGYEL

SEQ ID NO: 2532 - protein, 9 aa, Homo sapiens
YSFRHGYEL

SEQ ID NO: 2533 - protein, 9 aa, Homo sapiens
ERPSWVTEM

SEQ ID NO: 2534 - protein, 9 aa, Homo sapiens
YLWPPVQLA

SEQ ID NO: 2535 - protein, 9 aa, Homo sapiens
KAYGSHCCA

SEQ ID NO: 2536 - protein, 9 aa, Homo sapiens
GSHCCALFL

SEQ ID NO: 2537 - protein, 9 aa, Homo sapiens
LHRKLQEYL

SEQ ID NO: 2538 - protein, 9 aa, Homo sapiens
KFRCKNRHC

SEQ ID NO: 2539 - protein, 9 aa, Homo sapiens
YTYTMTHAA

SEQ ID NO: 2540 - protein, 9 aa, Homo sapiens
YVLTALPWK

SEQ ID NO: 2541 - protein, 9 aa, Homo sapiens
VHASSPTSL

SEQ ID NO: 2542 - protein, 9 aa, Homo sapiens
RVRKPVNVR

SEQ ID NO: 2543 - protein, 9 aa, Homo sapiens
VRKPVNVRM

SEQ ID NO: 2544 - protein, 9 aa, Homo sapiens
RGFQVKRSK

SEQ ID NO: 2545 - protein, 9 aa, Homo sapiens
ATMVFTTHV

SEQ ID NO: 2546 - protein, 9 aa, Homo sapiens
ATMVFTTHV

SEQ ID NO: 2547 - protein, 9 aa, Homo sapiens
LREPQATMV

SEQ ID NO: 2548 - protein, 9 aa, Homo sapiens
GLYDRCMVT

SEQ ID NO: 2549 - protein, 9 aa, Homo sapiens
RLRAGLYDR

SEQ ID NO: 2550 - protein, 9 aa, Homo sapiens
QVWFKVSRV

SEQ ID NO: 2551 - protein, 9 aa, Homo sapiens
KVSRVYTLV

SEQ ID NO: 2552 - protein, 9 aa, Homo sapiens
KVSRVYTLV

SEQ ID NO: 2553 - protein, 9 aa, Homo sapiens
VSRVYTLVL

SEQ ID NO: 2554 - protein, 9 aa, Homo sapiens
FKVSRVYTL

SEQ ID NO: 2555 - protein, 9 aa, Homo sapiens
GEVAFALYM

SEQ ID NO: 2556 - protein, 9 aa, Homo sapiens
SSRGGFSIK

SEQ ID NO: 2557 - protein, 9 aa, Homo sapiens
KMIPSNIAI

SEQ ID NO: 2558 - protein, 9 aa, Homo sapiens
MIPSNIAIV

SEQ ID NO: 2559 - protein, 9 aa, Homo sapiens
KMIPSNIAI

SEQ ID NO: 2560 - protein, 9 aa, Homo sapiens
QRRSAQEIV

SEQ ID NO: 2561 - protein, 9 aa, Homo sapiens
RTKARSKSA

SEQ ID NO: 2562 - protein, 9 aa, Homo sapiens
KARSKSASR

SEQ ID NO: 2563 - protein, 9 aa, Homo sapiens
RSKSASRTH

SEQ ID NO: 2564 - protein, 9 aa, Homo sapiens
ITRLASHMA

SEQ ID NO: 2565 - protein, 9 aa, Homo sapiens
VTRLTFPLR

SEQ ID NO: 2566 - protein, 9 aa, Homo sapiens
PLRCVVLYA

SEQ ID NO: 2567 - protein, 9 aa, Homo sapiens
LMVPHSPSL

SEQ ID NO: 2568 - protein, 9 aa, Homo sapiens
ALWKNISKI

SEQ ID NO: 2569 - protein, 9 aa, Homo sapiens
RVANTNPAV

SEQ ID NO: 2570 - protein, 9 aa, Homo sapiens
RVANTNPAV

SEQ ID NO: 2571 - protein, 9 aa, Homo sapiens
GMYGSSLAA

SEQ ID NO: 2572 - protein, 9 aa, Homo sapiens
AGRRLPPSG

SEQ ID NO: 2573 - protein, 9 aa, Homo sapiens
KAIAKHLGI

SEQ ID NO: 2574 - protein, 9 aa, Homo sapiens
LLAHYLLCL

SEQ ID NO: 2575 - protein, 9 aa, Homo sapiens
SSMYTVTRK

SEQ ID NO: 2576 - protein, 9 aa, Homo sapiens
VTRKESMTV

SEQ ID NO: 2577 - protein, 9 aa, Homo sapiens
TRKESMTVV

SEQ ID NO: 2578 - protein, 9 aa, Homo sapiens
DLSEVLHQV

SEQ ID NO: 2579 - protein, 9 aa, Homo sapiens
KTSASSRFE

SEQ ID NO: 2580 - protein, 9 aa, Homo sapiens
SSRFETHQS

SEQ ID NO: 2581 - protein, 9 aa, Homo sapiens
MARCPYSPL

SEQ ID NO: 2582 - protein, 9 aa, Homo sapiens
SSNDANPPA

SEQ ID NO: 2583 - protein, 9 aa, Homo sapiens
SIADLLSSL

SEQ ID NO: 2584 - protein, 9 aa, Homo sapiens
QTRRSMTLK

SEQ ID NO: 2585 - protein, 9 aa, Homo sapiens
NRNLSNDEL

SEQ ID NO: 2586 - protein, 9 aa, Homo sapiens
FMRCKLSRL

SEQ ID NO: 2587 - protein, 9 aa, Homo sapiens
RCKLSRLQK

SEQ ID NO: 2588 - protein, 9 aa, Homo sapiens
GLQAIADLL

SEQ ID NO: 2589 - protein, 9 aa, Homo sapiens
EENSRPHTY

SEQ ID NO: 2590 - protein, 9 aa, Homo sapiens
ASRGPTAAH

SEQ ID NO: 2591 - protein, 9 aa, Homo sapiens
FKRPFVRIL

SEQ ID NO: 2592 - protein, 9 aa, Homo sapiens
KVKATTVFQ

SEQ ID NO: 2593 - protein, 9 aa, Homo sapiens
KATTVFQFL

SEQ ID NO: 2594 - protein, 9 aa, Homo sapiens
AQWLGPQLL

SEQ ID NO: 2595 - protein, 9 aa, Homo sapiens
QLLVSLWGL

SEQ ID NO: 2596 - protein, 9 aa, Homo sapiens
SSRYQVDLI

SEQ ID NO: 2597 - protein, 9 aa, Homo sapiens
SAIGVTAAK

SEQ ID NO: 2598 - protein, 9 aa, Homo sapiens
GARGGLGLV

SEQ ID NO: 2599 - protein, 9 aa, Homo sapiens
SAFDYFITA

SEQ ID NO: 2600 - protein, 9 aa, Homo sapiens
SAFDYFITA

SEQ ID NO: 2601 - protein, 9 aa, Homo sapiens
SESAFDYFI

SEQ ID NO: 2602 - protein, 9 aa, Homo sapiens
KTHRFSVVD

SEQ ID NO: 2603 - protein, 9 aa, Homo sapiens
KLSEYHNSL

SEQ ID NO: 2604 - protein, 9 aa, Homo sapiens
YHNSLESKL

SEQ ID NO: 2605 - protein, 9 aa, Homo sapiens
AQSELPFAA

SEQ ID NO: 2606 - protein, 9 aa, Homo sapiens
FRQGSVTPM

SEQ ID NO: 2607 - protein, 9 aa, Homo sapiens
GLLALRLLL

SEQ ID NO: 2608 - protein, 9 aa, Homo sapiens
KLNLRIHEM

SEQ ID NO: 2609 - protein, 9 aa, Homo sapiens
SVRNAHRQI

SEQ ID NO: 2610 - protein, 9 aa, Homo sapiens
VRNAHRQIP

SEQ ID NO: 2611 - protein, 9 aa, Homo sapiens
QRCELLSRL

SEQ ID NO: 2612 - protein, 9 aa, Homo sapiens
SLRSRKSPI

SEQ ID NO: 2613 - protein, 9 aa, Homo sapiens
RSRKSPIPA

SEQ ID NO: 2614 - protein, 9 aa, Homo sapiens
FMLSLCLVL

SEQ ID NO: 2615 - protein, 9 aa, Homo sapiens
MLSLCLVLT

SEQ ID NO: 2616 - protein, 9 aa, Homo sapiens
SLCLVLTFA

SEQ ID NO: 2617 - protein, 9 aa, Homo sapiens
VLTFAVSCL

SEQ ID NO: 2618 - protein, 9 aa, Homo sapiens
LTFAVSCLL

SEQ ID NO: 2619 - protein, 9 aa, Homo sapiens
LTFAVSCLL

SEQ ID NO: 2620 - protein, 9 aa, Homo sapiens
QRIYDGQYF

SEQ ID NO: 2621 - protein, 9 aa, Homo sapiens
REELAQFHW

SEQ ID NO: 2622 - protein, 9 aa, Homo sapiens
EELAQFHWD

SEQ ID NO: 2623 - protein, 9 aa, Homo sapiens
FHWDGALTQ

SEQ ID NO: 2624 - protein, 9 aa, Homo sapiens
CYRDFMQLI

SEQ ID NO: 2625 - protein, 9 aa, Homo sapiens
KFRCDRPFH

SEQ ID NO: 2626 - protein, 9 aa, Homo sapiens
VYFGNPYTF

SEQ ID NO: 2627 - protein, 9 aa, Homo sapiens
KAQEVPPLA

SEQ ID NO: 2628 - protein, 9 aa, Homo sapiens
ATRNSILGS

SEQ ID NO: 2629 - protein, 9 aa, Homo sapiens
TRNSILGSL

SEQ ID NO: 2630 - protein, 9 aa, Homo sapiens
AVRTVHGNS

SEQ ID NO: 2631 - protein, 9 aa, Homo sapiens
VRTVHGNSF

SEQ ID NO: 2632 - protein, 9 aa, Homo sapiens
TVRRWNYSS

SEQ ID NO: 2633 - protein, 9 aa, Homo sapiens
RRWNYSSPL

SEQ ID NO: 2634 - protein, 9 aa, Homo sapiens
LVHRVKEVK

SEQ ID NO: 2635 - protein, 9 aa, Homo sapiens
HLRATFLGL

SEQ ID NO: 2636 - protein, 9 aa, Homo sapiens
LHHLRATFL

SEQ ID NO: 2637 - protein, 9 aa, Homo sapiens
WIYWDSNTL

SEQ ID NO: 2638 - protein, 9 aa, Homo sapiens
KLAPHYFLS

SEQ ID NO: 2639 - protein, 9 aa, Homo sapiens
YFLSISYKI

SEQ ID NO: 2640 - protein, 9 aa, Homo sapiens
HYFLSISYK

SEQ ID NO: 2641 - protein, 9 aa, Homo sapiens
RSRVSSSHG

SEQ ID NO: 2642 - protein, 9 aa, Homo sapiens
RVSSSHGPR

SEQ ID NO: 2643 - protein, 9 aa, Homo sapiens
VSSSHGPRK

SEQ ID NO: 2644 - protein, 9 aa, Homo sapiens
VQRGARPGA

SEQ ID NO: 2645 - protein, 9 aa, Homo sapiens
RLGEVEAAL

SEQ ID NO: 2646 - protein, 9 aa, Homo sapiens
MASRGRSLK

SEQ ID NO: 2647 - protein, 9 aa, Homo sapiens
ASRGRSLKQ

SEQ ID NO: 2648 - protein, 9 aa, Homo sapiens
RSLKQTSLA

SEQ ID NO: 2649 - protein, 9 aa, Homo sapiens
MSRPGKSSY

SEQ ID NO: 2650 - protein, 9 aa, Homo sapiens
FTFDFVFGI

SEQ ID NO: 2651 - protein, 9 aa, Homo sapiens
FTFDFVFGI

SEQ ID NO: 2652 - protein, 9 aa, Homo sapiens
RRYDRDSRC

SEQ ID NO: 2653 - protein, 9 aa, Homo sapiens
RAKPGPEMA

SEQ ID NO: 2654 - protein, 9 aa, Homo sapiens
VRAKPGPEM

SEQ ID NO: 2655 - protein, 9 aa, Homo sapiens
GSRPCRQRY

SEQ ID NO: 2656 - protein, 9 aa, Homo sapiens
RQRYPFRVR

SEQ ID NO: 2657 - protein, 9 aa, Homo sapiens
RYPFRVRFA

SEQ ID NO: 2658 - protein, 9 aa, Homo sapiens
QRYPFRVRF

SEQ ID NO: 2659 - protein, 9 aa, Homo sapiens
VHTDKKPAL

SEQ ID NO: 2660 - protein, 9 aa, Homo sapiens
FQWRKEISI

SEQ ID NO: 2661 - protein, 9 aa, Homo sapiens
YLGLLPAAT

SEQ ID NO: 2662 - protein, 9 aa, Homo sapiens
IHVSLVAQL

SEQ ID NO: 2663 - protein, 9 aa, Homo sapiens
RSAPATPVL

SEQ ID NO: 2664 - protein, 9 aa, Homo sapiens
CRYEDLASL

SEQ ID NO: 2665 - protein, 9 aa, Homo sapiens
KRRRNWPEA

SEQ ID NO: 2666 - protein, 9 aa, Homo sapiens
RRRNWPEAF

SEQ ID NO: 2667 - protein, 9 aa, Homo sapiens
RAMFYLFSA

SEQ ID NO: 2668 - protein, 9 aa, Homo sapiens
RAMFYLFSA

SEQ ID NO: 2669 - protein, 9 aa, Homo sapiens
TIWPNATAV

SEQ ID NO: 2670 - protein, 9 aa, Homo sapiens
SSHTRPLSA

SEQ ID NO: 2671 - protein, 9 aa, Homo sapiens
HTRPLSAIA

SEQ ID NO: 2672 - protein, 9 aa, Homo sapiens
FLGFLGDEL

SEQ ID NO: 2673 - protein, 9 aa, Homo sapiens
SLDENECRL

SEQ ID NO: 2674 - protein, 9 aa, Homo sapiens
RLMKGNPSA

SEQ ID NO: 2675 - protein, 9 aa, Homo sapiens
RLMKGNPSA

SEQ ID NO: 2676 - protein, 9 aa, Homo sapiens
VENEFKADY

SEQ ID NO: 2677 - protein, 9 aa, Homo sapiens
KVIEIDDTL

SEQ ID NO: 2678 - protein, 9 aa, Homo sapiens
LRLQEQVAL

SEQ ID NO: 2679 - protein, 9 aa, Homo sapiens
VVIGSIGAL

SEQ ID NO: 2680 - protein, 9 aa, Homo sapiens
RPMYNHPAG

SEQ ID NO: 2681 - protein, 9 aa, Homo sapiens
YFSTRMSRM

SEQ ID NO: 2682 - protein, 9 aa, Homo sapiens
VYEAGEISF

SEQ ID NO: 2683 - protein, 9 aa, Homo sapiens
RVHTGERPF

SEQ ID NO: 2684 - protein, 9 aa, Homo sapiens
GYRSYFTQI

SEQ ID NO: 2685 - protein, 9 aa, Homo sapiens
SYFTQIVGF

SEQ ID NO: 2686 - protein, 9 aa, Homo sapiens
SYFTQIVGF

SEQ ID NO: 2687 - protein, 9 aa, Homo sapiens
CYNKTLLRL

SEQ ID NO: 2688 - protein, 9 aa, Homo sapiens
YPREDTRAH

SEQ ID NO: 2689 - protein, 9 aa, Homo sapiens
HRETNLHYL

SEQ ID NO: 2690 - protein, 9 aa, Homo sapiens
LHTHMYFFI

SEQ ID NO: 2691 - protein, 9 aa, Homo sapiens
HLHTHMYFF

SEQ ID NO: 2692 - protein, 9 aa, Homo sapiens
APEEKGQVA

SEQ ID NO: 2693 - protein, 9 aa, Homo sapiens
RRVPPHVLL

SEQ ID NO: 2694 - protein, 9 aa, Homo sapiens
RVKGPLLVL

SEQ ID NO: 2695 - protein, 9 aa, Homo sapiens
HYVPPVCIY

SEQ ID NO: 2696 - protein, 9 aa, Homo sapiens
HFNSIIKQL

SEQ ID NO: 2697 - protein, 9 aa, Homo sapiens
VYPGHRHGL

SEQ ID NO: 2698 - protein, 9 aa, Homo sapiens
AVQTNGSPL

SEQ ID NO: 2699 - protein, 9 aa, Homo sapiens
APTIPVRRL

SEQ ID NO: 2700 - protein, 9 aa, Homo sapiens
IPVRRLLAW

SEQ ID NO: 2701 - protein, 9 aa, Homo sapiens
EYAIATFNV

SEQ ID NO: 2702 - protein, 9 aa, Homo sapiens
GRLTELLTF

SEQ ID NO: 2703 - protein, 9 aa, Homo sapiens
LFIIGSHTL

SEQ ID NO: 2704 - protein, 9 aa, Homo sapiens
RFPAEMQKL

SEQ ID NO: 2705 - protein, 9 aa, Homo sapiens
NARRSSHML

SEQ ID NO: 2706 - protein, 9 aa, Homo sapiens
APGACGLLL

SEQ ID NO: 2707 - protein, 9 aa, Homo sapiens
IYREFELLI

SEQ ID NO: 2708 - protein, 9 aa, Homo sapiens
SMTPDVKHL

SEQ ID NO: 2709 - protein, 9 aa, Homo sapiens
QYFNGVLDI

SEQ ID NO: 2710 - protein, 9 aa, Homo sapiens
QPRQYFNGV

SEQ ID NO: 2711 - protein, 9 aa, Homo sapiens
RPASVCSSV

SEQ ID NO: 2712 - protein, 9 aa, Homo sapiens
YLQNQTFCL

SEQ ID NO: 2713 - protein, 9 aa, Homo sapiens
GPEVYVLPL

SEQ ID NO: 2714 - protein, 9 aa, Homo sapiens
LFSDIVLPL

SEQ ID NO: 2715 - protein, 9 aa, Homo sapiens
WPHTREKPF

SEQ ID NO: 2716 - protein, 9 aa, Homo sapiens
SPHSPNAPM

SEQ ID NO: 2717 - protein, 9 aa, Homo sapiens
EYDPSKVTF

SEQ ID NO: 2718 - protein, 9 aa, Homo sapiens
QPRPPTRPT

SEQ ID NO: 2719 - protein, 9 aa, Homo sapiens
PPTRPTTSL

SEQ ID NO: 2720 - protein, 9 aa, Homo sapiens
APALWLGVV

SEQ ID NO: 2721 - protein, 9 aa, Homo sapiens
SKSPHWRIL

SEQ ID NO: 2722 - protein, 9 aa, Homo sapiens
RPSLSVQTV

SEQ ID NO: 2723 - protein, 9 aa, Homo sapiens
APVKLGLRA

SEQ ID NO: 2724 - protein, 9 aa, Homo sapiens
YRHRSAHTI

SEQ ID NO: 2725 - protein, 9 aa, Homo sapiens
TPPAPAPAV

SEQ ID NO: 2726 - protein, 9 aa, Homo sapiens
NPWSSSRIA

SEQ ID NO: 2727 - protein, 9 aa, Homo sapiens
VPIGSMDVF

SEQ ID NO: 2728 - protein, 9 aa, Homo sapiens
PPMRRWGSV

SEQ ID NO: 2729 - protein, 9 aa, Homo sapiens
PPVTPPPPL

SEQ ID NO: 2730 - protein, 9 aa, Homo sapiens
VYSKAVIRL

SEQ ID NO: 2731 - protein, 9 aa, Homo sapiens
VYSKAVIRL

SEQ ID NO: 2732 - protein, 9 aa, Homo sapiens
RRLKRGAKL

SEQ ID NO: 2733 - protein, 9 aa, Homo sapiens
RPVRPVVQL

SEQ ID NO: 2734 - protein, 9 aa, Homo sapiens
YGYEGRVPL

SEQ ID NO: 2735 - protein, 9 aa, Homo sapiens
RDAGSTQAL

SEQ ID NO: 2736 - protein, 9 aa, Homo sapiens
CWLSYILPF

SEQ ID NO: 2737 - protein, 9 aa, Homo sapiens
CWLSYILPF

SEQ ID NO: 2738 - protein, 9 aa, Homo sapiens
YHFLYSCSY

SEQ ID NO: 2739 - protein, 9 aa, Homo sapiens
APLSSNISI

SEQ ID NO: 2740 - protein, 9 aa, Homo sapiens
VSHACYQLF

SEQ ID NO: 2741 - protein, 9 aa, Homo sapiens
MPRHNGEAG

SEQ ID NO: 2742 - protein, 9 aa, Homo sapiens
ALARKFITF

SEQ ID NO: 2743 - protein, 9 aa, Homo sapiens
FYTLCKELL

SEQ ID NO: 2744 - protein, 9 aa, Homo sapiens
FYTLCKELL

SEQ ID NO: 2745 - protein, 9 aa, Homo sapiens
LYMLCKELL

SEQ ID NO: 2746 - protein, 9 aa, Homo sapiens
LYMLCKELL

SEQ ID NO: 2747 - protein, 9 aa, Homo sapiens
IYETHSHKL

SEQ ID NO: 2748 - protein, 9 aa, Homo sapiens
IYETHSHKL

SEQ ID NO: 2749 - protein, 9 aa, Homo sapiens
TPVNSNSPV

SEQ ID NO: 2750 - protein, 9 aa, Homo sapiens
SMLAAMFLI

SEQ ID NO: 2751 - protein, 9 aa, Homo sapiens
MLAAMFLIF

SEQ ID NO: 2752 - protein, 9 aa, Homo sapiens
KPNAMGLAQ

SEQ ID NO: 2753 - protein, 9 aa, Homo sapiens
KPGVQRTVT

SEQ ID NO: 2754 - protein, 9 aa, Homo sapiens
SPFIAVLLL

SEQ ID NO: 2755 - protein, 9 aa, Homo sapiens
HSSPFIAVL

SEQ ID NO: 2756 - protein, 9 aa, Homo sapiens
GPTEQSSLL

SEQ ID NO: 2757 - protein, 9 aa, Homo sapiens
HAHKWYRDL

SEQ ID NO: 2758 - protein, 9 aa, Homo sapiens
WYRDLCLLL

SEQ ID NO: 2759 - protein, 9 aa, Homo sapiens
KFGAVNLVI

SEQ ID NO: 2760 - protein, 9 aa, Homo sapiens
EPRKIQARM

SEQ ID NO: 2761 - protein, 9 aa, Homo sapiens
ARLSAATVL

SEQ ID NO: 2762 - protein, 9 aa, Homo sapiens
NLRVAGGVL

SEQ ID NO: 2763 - protein, 9 aa, Homo sapiens
RVAGGVLPV

SEQ ID NO: 2764 - protein, 9 aa, Homo sapiens
RYVAICNAL

SEQ ID NO: 2765 - protein, 9 aa, Homo sapiens
SPTGPLCPA

SEQ ID NO: 2766 - protein, 9 aa, Homo sapiens
NWVTTHTTF

SEQ ID NO: 2767 - protein, 9 aa, Homo sapiens
RPQPAEGPQ

SEQ ID NO: 2768 - protein, 9 aa, Homo sapiens
YCFECHLPA

SEQ ID NO: 2769 - protein, 9 aa, Homo sapiens
NSFQGTIRK

SEQ ID NO: 2770 - protein, 9 aa, Homo sapiens
AQTNCHILR

SEQ ID NO: 2771 - protein, 9 aa, Homo sapiens
RLADGTEAA

SEQ ID NO: 2772 - protein, 9 aa, Homo sapiens
YRHMWSLEI

SEQ ID NO: 2773 - protein, 9 aa, Homo sapiens
SPVNVSSTV

SEQ ID NO: 2774 - protein, 9 aa, Homo sapiens
RVDNNGALL

SEQ ID NO: 2775 - protein, 9 aa, Homo sapiens
TRVDNNGAL

SEQ ID NO: 2776 - protein, 9 aa, Homo sapiens
LMIRWLRGV

SEQ ID NO: 2777 - protein, 9 aa, Homo sapiens
YSLMIRWLR

SEQ ID NO: 2778 - protein, 9 aa, Homo sapiens
IRWLRGVRL

SEQ ID NO: 2779 - protein, 9 aa, Homo sapiens
VTLALQWQR

SEQ ID NO: 2780 - protein, 9 aa, Homo sapiens
ILALIGEEV

SEQ ID NO: 2781 - protein, 9 aa, Homo sapiens
YMLTLHTKL

SEQ ID NO: 2782 - protein, 9 aa, Homo sapiens
RIWKETEFK

SEQ ID NO: 2783 - protein, 9 aa, Homo sapiens
VLASGAFGT

SEQ ID NO: 2784 - protein, 9 aa, Homo sapiens
AQYREAMEV

SEQ ID NO: 2785 - protein, 9 aa, Homo sapiens
YREAMEVDL

SEQ ID NO: 2786 - protein, 9 aa, Homo sapiens
SSDRHLVPV

SEQ ID NO: 2787 - protein, 9 aa, Homo sapiens
ASSNFRHEY

SEQ ID NO: 2788 - protein, 9 aa, Homo sapiens
MVLKATESF

SEQ ID NO: 2789 - protein, 9 aa, Homo sapiens
SPRPILAVL

SEQ ID NO: 2790 - protein, 9 aa, Homo sapiens
QSLRGPVHL

SEQ ID NO: 2791 - protein, 9 aa, Homo sapiens
HALRGPVHL

SEQ ID NO: 2792 - protein, 9 aa, Homo sapiens
SSHEAVVSL

SEQ ID NO: 2793 - protein, 9 aa, Homo sapiens
STAELRLNY

SEQ ID NO: 2794 - protein, 9 aa, Homo sapiens
LNYNEISIL

SEQ ID NO: 2795 - protein, 9 aa, Homo sapiens
LVLIHHCAK

SEQ ID NO: 2796 - protein, 9 aa, Homo sapiens
FCVTLGLLV

SEQ ID NO: 2797 - protein, 9 aa, Homo sapiens
VTLGLLVLI

SEQ ID NO: 2798 - protein, 9 aa, Homo sapiens
DHDLHCSSI

SEQ ID NO: 2799 - protein, 9 aa, Homo sapiens
WYFLSEATV

SEQ ID NO: 2800 - protein, 9 aa, Homo sapiens
FLSEATVTL

SEQ ID NO: 2801 - protein, 9 aa, Homo sapiens
NMLNLAVLL

SEQ ID NO: 2802 - protein, 9 aa, Homo sapiens
LSFSGNPLR

SEQ ID NO: 2803 - protein, 9 aa, Homo sapiens
FPAIHERPV

SEQ ID NO: 2804 - protein, 9 aa, Homo sapiens
SQNQYDVVL

SEQ ID NO: 2805 - protein, 9 aa, Homo sapiens
NQYDVVLHV

SEQ ID NO: 2806 - protein, 9 aa, Homo sapiens
YPYRTTVGY

SEQ ID NO: 2807 - protein, 9 aa, Homo sapiens
SSMATSSQY

SEQ ID NO: 2808 - protein, 9 aa, Homo sapiens
FEHNLQLCV

SEQ ID NO: 2809 - protein, 9 aa, Homo sapiens
MSRGTPSLV

SEQ ID NO: 2810 - protein, 9 aa, Homo sapiens
MLSQMLSAI

SEQ ID NO: 2811 - protein, 9 aa, Homo sapiens
VSQWLQGLR

SEQ ID NO: 2812 - protein, 9 aa, Homo sapiens
SQWLQGLRK

SEQ ID NO: 2813 - protein, 9 aa, Homo sapiens
LPAVTVTPV

SEQ ID NO: 2814 - protein, 9 aa, Homo sapiens
DPYFKLHLL

SEQ ID NO: 2815 - protein, 9 aa, Homo sapiens
WVHPSSPPV

SEQ ID NO: 2816 - protein, 9 aa, Homo sapiens
KVTEKIHRV

SEQ ID NO: 2817 - protein, 9 aa, Homo sapiens
PASRHAGNI

SEQ ID NO: 2818 - protein, 9 aa, Homo sapiens
FPPGPQEEV

SEQ ID NO: 2819 - protein, 9 aa, Homo sapiens
SVCPTPGCR

SEQ ID NO: 2820 - protein, 9 aa, Homo sapiens
VTCKSGDFR

SEQ ID NO: 2821 - protein, 9 aa, Homo sapiens
EARVICVSI

SEQ ID NO: 2822 - protein, 9 aa, Homo sapiens
RMLPSERYK

SEQ ID NO: 2823 - protein, 9 aa, Homo sapiens
STVELLTSI

SEQ ID NO: 2824 - protein, 9 aa, Homo sapiens
LGYSGSKPV

SEQ ID NO: 2825 - protein, 9 aa, Homo sapiens
YSGSKPVVI

SEQ ID NO: 2826 - protein, 9 aa, Homo sapiens
GAAPPPPLL

SEQ ID NO: 2827 - protein, 9 aa, Homo sapiens
RSLTLLINR

SEQ ID NO: 2828 - protein, 9 aa, Homo sapiens
IMRSLTLLI

SEQ ID NO: 2829 - protein, 9 aa, Homo sapiens
WSNQRWSRV

SEQ ID NO: 2830 - protein, 9 aa, Homo sapiens
YAYTNVTGP

SEQ ID NO: 2831 - protein, 9 aa, Homo sapiens
HHATLRLDL

SEQ ID NO: 2832 - protein, 9 aa, Homo sapiens
HASLPDSSL

SEQ ID NO: 2833 - protein, 9 aa, Homo sapiens
FLCSGCRRL

SEQ ID NO: 2834 - protein, 9 aa, Homo sapiens
LVLNVWRKV

SEQ ID NO: 2835 - protein, 9 aa, Homo sapiens
KLIQAATLK

SEQ ID NO: 2836 - protein, 9 aa, Homo sapiens
YKLIQAATL

SEQ ID NO: 2837 - protein, 9 aa, Homo sapiens
QAATLKNTL

SEQ ID NO: 2838 - protein, 9 aa, Homo sapiens
RVNLASRPK

SEQ ID NO: 2839 - protein, 9 aa, Homo sapiens
CAALDLAII

SEQ ID NO: 2840 - protein, 9 aa, Homo sapiens
SFNVAQTMF

SEQ ID NO: 2841 - protein, 9 aa, Homo sapiens
HSFNVAQTM

SEQ ID NO: 2842 - protein, 9 aa, Homo sapiens
HTAYSSELK

SEQ ID NO: 2843 - protein, 9 aa, Homo sapiens
RHTAYSSEL

SEQ ID NO: 2844 - protein, 9 aa, Homo sapiens
YSSELKAKL

SEQ ID NO: 2845 - protein, 9 aa, Homo sapiens
AVCEFLQHY

SEQ ID NO: 2846 - protein, 9 aa, Homo sapiens
QHYNLLSIL

SEQ ID NO: 2847 - protein, 9 aa, Homo sapiens
AVCEFLQHY

SEQ ID NO: 2848 - protein, 9 aa, Homo sapiens
LQHYNLLSI

SEQ ID NO: 2849 - protein, 9 aa, Homo sapiens
QHYNLLSIL

SEQ ID NO: 2850 - protein, 9 aa, Homo sapiens
STYMAATVL

SEQ ID NO: 2851 - protein, 9 aa, Homo sapiens
MAATVLSAV

SEQ ID NO: 2852 - protein, 9 aa, Homo sapiens
ALSESSSHK

SEQ ID NO: 2853 - protein, 9 aa, Homo sapiens
LADQLHKPV

SEQ ID NO: 2854 - protein, 9 aa, Homo sapiens
PASELVQDV

SEQ ID NO: 2855 - protein, 9 aa, Homo sapiens
KATQSILQK

SEQ ID NO: 2856 - protein, 9 aa, Homo sapiens
FIKATQSIL

SEQ ID NO: 2857 - protein, 9 aa, Homo sapiens
AALPPAVPL

SEQ ID NO: 2858 - protein, 9 aa, Homo sapiens
RSGNQTLNY

SEQ ID NO: 2859 - protein, 9 aa, Homo sapiens
YTCDERGKV

SEQ ID NO: 2860 - protein, 9 aa, Homo sapiens
DVKFNSAHI

SEQ ID NO: 2861 - protein, 9 aa, Homo sapiens
SAHIPGSPF

SEQ ID NO: 2862 - protein, 9 aa, Homo sapiens
YPSGSRTQL

SEQ ID NO: 2863 - protein, 9 aa, Homo sapiens
LQVTFTCTI

SEQ ID NO: 2864 - protein, 9 aa, Homo sapiens
IEAEPGHYI

SEQ ID NO: 2865 - protein, 9 aa, Homo sapiens
TSFSVLWVY

SEQ ID NO: 2866 - protein, 9 aa, Homo sapiens
LAGTSFSVL

SEQ ID NO: 2867 - protein, 9 aa, Homo sapiens
LVLHWKLTK

SEQ ID NO: 2868 - protein, 9 aa, Homo sapiens
VICDDNGSK

SEQ ID NO: 2869 - protein, 9 aa, Homo sapiens
YADRRGKKL

SEQ ID NO: 2870 - protein, 9 aa, Homo sapiens
QAERAEGHL

SEQ ID NO: 2871 - protein, 9 aa, Homo sapiens
KIIEHFRRY

SEQ ID NO: 2872 - protein, 9 aa, Homo sapiens
KIIEHFRRY

SEQ ID NO: 2873 - protein, 9 aa, Homo sapiens
RRYGRVESV

SEQ ID NO: 2874 - protein, 9 aa, Homo sapiens
HSADNNIIY

SEQ ID NO: 2875 - protein, 9 aa, Homo sapiens
HSADNNIIY

SEQ ID NO: 2876 - protein, 9 aa, Homo sapiens
SADNNIIYF

SEQ ID NO: 2877 - protein, 9 aa, Homo sapiens
EHSADNNII

SEQ ID NO: 2878 - protein, 9 aa, Homo sapiens
HSADNNIIY

SEQ ID NO: 2879 - protein, 9 aa, Homo sapiens
SADNNIIYF

SEQ ID NO: 2880 - protein, 9 aa, Homo sapiens
TAQEFIHQF

SEQ ID NO: 2881 - protein, 9 aa, Homo sapiens
TAQEFIHQF

SEQ ID NO: 2882 - protein, 9 aa, Homo sapiens
EAQEFIHQF

SEQ ID NO: 2883 - protein, 9 aa, Homo sapiens
EAQEFIHQF

SEQ ID NO: 2884 - protein, 9 aa, Homo sapiens
EAQEFIHQF

SEQ ID NO: 2885 - protein, 9 aa, Homo sapiens
TQATGNSAF

SEQ ID NO: 2886 - protein, 9 aa, Homo sapiens
DVHMVSDSY

SEQ ID NO: 2887 - protein, 9 aa, Homo sapiens
DVHMVSDSY

SEQ ID NO: 2888 - protein, 9 aa, Homo sapiens
KMLEAQNAL

SEQ ID NO: 2889 - protein, 9 aa, Homo sapiens
KMLEAQNAL

SEQ ID NO: 2890 - protein, 9 aa, Homo sapiens
LPDKLRPLY

SEQ ID NO: 2891 - protein, 9 aa, Homo sapiens
MLPDKLRPL

SEQ ID NO: 2892 - protein, 9 aa, Homo sapiens
RPLVERFTF

SEQ ID NO: 2893 - protein, 9 aa, Homo sapiens
QPLASSKQM

SEQ ID NO: 2894 - protein, 9 aa, Homo sapiens
VAYTYSTTF

SEQ ID NO: 2895 - protein, 9 aa, Homo sapiens
VAYTYSTTF

SEQ ID NO: 2896 - protein, 9 aa, Homo sapiens
VAYTYSTTF

SEQ ID NO: 2897 - protein, 9 aa, Homo sapiens
YSTTFSPAV

SEQ ID NO: 2898 - protein, 9 aa, Homo sapiens
NTIHEGYVY

SEQ ID NO: 2899 - protein, 9 aa, Homo sapiens
HVFPSNTIH

SEQ ID NO: 2900 - protein, 9 aa, Homo sapiens
FPSNTIHEG

SEQ ID NO: 2901 - protein, 9 aa, Homo sapiens
NTIHEGYVY

SEQ ID NO: 2902 - protein, 9 aa, Homo sapiens
YTSHNVLTK

SEQ ID NO: 2903 - protein, 9 aa, Homo sapiens
NHAYHGGVL

SEQ ID NO: 2904 - protein, 9 aa, Homo sapiens
YRDPPYHSW

SEQ ID NO: 2905 - protein, 9 aa, Homo sapiens
ATWSGWLKI

SEQ ID NO: 2906 - protein, 9 aa, Homo sapiens
HIAICLDPY

SEQ ID NO: 2907 - protein, 9 aa, Homo sapiens
YSSRHIAIC

SEQ ID NO: 2908 - protein, 9 aa, Homo sapiens
LVINCHQRV

SEQ ID NO: 2909 - protein, 9 aa, Homo sapiens
DSFGRGGNF

SEQ ID NO: 2910 - protein, 9 aa, Homo sapiens
DAAGVSQLF

SEQ ID NO: 2911 - protein, 9 aa, Homo sapiens
DAAGVSQLF

SEQ ID NO: 2912 - protein, 9 aa, Homo sapiens
DAAGVSQLF

SEQ ID NO: 2913 - protein, 9 aa, Homo sapiens
FSKNLIYTY

SEQ ID NO: 2914 - protein, 9 aa, Homo sapiens
FSKNLIYTY

SEQ ID NO: 2915 - protein, 9 aa, Homo sapiens
SAFDQDRSL

SEQ ID NO: 2916 - protein, 9 aa, Homo sapiens
YALYCPDTL

SEQ ID NO: 2917 - protein, 9 aa, Homo sapiens
YCPDTLTAF

SEQ ID NO: 2918 - protein, 9 aa, Homo sapiens
YALYCPDTL

SEQ ID NO: 2919 - protein, 9 aa, Homo sapiens
YCPDTLTAF

SEQ ID NO: 2920 - protein, 9 aa, Homo sapiens
DTLTAFPTV

SEQ ID NO: 2921 - protein, 9 aa, Homo sapiens
AAAENLNAV

SEQ ID NO: 2922 - protein, 9 aa, Homo sapiens
DKYFVQVVI

SEQ ID NO: 2923 - protein, 9 aa, Homo sapiens
KYFVQVVIV

SEQ ID NO: 2924 - protein, 9 aa, Homo sapiens
SPVPTAPTF

SEQ ID NO: 2925 - protein, 9 aa, Homo sapiens
FPGGATAVA

SEQ ID NO: 2926 - protein, 9 aa, Homo sapiens
ESFPGGATA

SEQ ID NO: 2927 - protein, 9 aa, Homo sapiens
SSLEEISMY

SEQ ID NO: 2928 - protein, 9 aa, Homo sapiens
MANSSLEEI

SEQ ID NO: 2929 - protein, 9 aa, Homo sapiens
SSLEEISMY

SEQ ID NO: 2930 - protein, 9 aa, Homo sapiens
FSLFGIHNM

SEQ ID NO: 2931 - protein, 9 aa, Homo sapiens
QMCAKISSF

SEQ ID NO: 2932 - protein, 9 aa, Homo sapiens
FCSVTSEPI

SEQ ID NO: 2933 - protein, 9 aa, Homo sapiens
VTSEPISEV

SEQ ID NO: 2934 - protein, 9 aa, Homo sapiens
IFYRIVKCI

SEQ ID NO: 2935 - protein, 9 aa, Homo sapiens
LAHGEELRY

SEQ ID NO: 2936 - protein, 9 aa, Homo sapiens
EVVFCFEQF

SEQ ID NO: 2937 - protein, 9 aa, Homo sapiens
LQQDVSATV

SEQ ID NO: 2938 - protein, 9 aa, Homo sapiens
LPRVCTRSL

SEQ ID NO: 2939 - protein, 9 aa, Homo sapiens
GASEGLPRV

SEQ ID NO: 2940 - protein, 9 aa, Homo sapiens
KLNQVLDQF

SEQ ID NO: 2941 - protein, 9 aa, Homo sapiens
FAGHVHDRY

SEQ ID NO: 2942 - protein, 9 aa, Homo sapiens
FAGHVHDRY

SEQ ID NO: 2943 - protein, 9 aa, Homo sapiens
IVKQGCVKI

SEQ ID NO: 2944 - protein, 9 aa, Homo sapiens
NPILHAVMV

SEQ ID NO: 2945 - protein, 9 aa, Homo sapiens
IAVFRGLAY

SEQ ID NO: 2946 - protein, 9 aa, Homo sapiens
IAVFRGLAY

SEQ ID NO: 2947 - protein, 9 aa, Homo sapiens
AVFRGLAYL

SEQ ID NO: 2948 - protein, 9 aa, Homo sapiens
LPLVPESRV

SEQ ID NO: 2949 - protein, 9 aa, Homo sapiens
KSVVIMVPV

SEQ ID NO: 2950 - protein, 9 aa, Homo sapiens
WPPFEYIIL

SEQ ID NO: 2951 - protein, 9 aa, Homo sapiens
TEWPPFEYI

SEQ ID NO: 2952 - protein, 9 aa, Homo sapiens
FEYIILATI

SEQ ID NO: 2953 - protein, 9 aa, Homo sapiens
DNFALTEHM

SEQ ID NO: 2954 - protein, 9 aa, Homo sapiens
HHNECEKSF

SEQ ID NO: 2955 - protein, 9 aa, Homo sapiens
TSEKPTDAY

SEQ ID NO: 2956 - protein, 9 aa, Homo sapiens
HPRPFTHGF

SEQ ID NO: 2957 - protein, 9 aa, Homo sapiens
RPFTHGFSF

SEQ ID NO: 2958 - protein, 9 aa, Homo sapiens
YALHRISKQ

SEQ ID NO: 2959 - protein, 9 aa, Homo sapiens
HVWEDFSGL

SEQ ID NO: 2960 - protein, 9 aa, Homo sapiens
VPPPRIPPI

SEQ ID NO: 2961 - protein, 9 aa, Homo sapiens
TPVSQPPPV

SEQ ID NO: 2962 - protein, 9 aa, Homo sapiens
TALATVGLY

SEQ ID NO: 2963 - protein, 9 aa, Homo sapiens
TALATVGLY

SEQ ID NO: 2964 - protein, 9 aa, Homo sapiens
KEINWLSIL

SEQ ID NO: 2965 - protein, 9 aa, Homo sapiens
RTQRRKYTI

SEQ ID NO: 2966 - protein, 9 aa, Homo sapiens
RTQRRKYTI

SEQ ID NO: 2967 - protein, 9 aa, Homo sapiens
VPMVVVIAL

SEQ ID NO: 2968 - protein, 9 aa, Homo sapiens
VVVIALSVY

SEQ ID NO: 2969 - protein, 9 aa, Homo sapiens
MVVVIALSV

SEQ ID NO: 2970 - protein, 9 aa, Homo sapiens
QVDEGNTAV

SEQ ID NO: 2971 - protein, 9 aa, Homo sapiens
APVCTDTTY

SEQ ID NO: 2972 - protein, 9 aa, Homo sapiens
AAPDTVVAL

SEQ ID NO: 2973 - protein, 9 aa, Homo sapiens
LSKDDIQRM

SEQ ID NO: 2974 - protein, 9 aa, Homo sapiens
IIYKKIALM

SEQ ID NO: 2975 - protein, 9 aa, Homo sapiens
IALMSANKL

SEQ ID NO: 2976 - protein, 9 aa, Homo sapiens
LVVKPGAMV

SEQ ID NO: 2977 - protein, 9 aa, Homo sapiens
FAFNFNSDT

SEQ ID NO: 2978 - protein, 9 aa, Homo sapiens
FNFNSDTDV

SEQ ID NO: 2979 - protein, 9 aa, Homo sapiens
EAPAKMGAL

SEQ ID NO: 2980 - protein, 9 aa, Homo sapiens
KLLQNFTCL

SEQ ID NO: 2981 - protein, 9 aa, Homo sapiens
FQRDKWKLL

SEQ ID NO: 2982 - protein, 9 aa, Homo sapiens
FHLTPPSPV

SEQ ID NO: 2983 - protein, 9 aa, Homo sapiens
FCMHNEEPF

SEQ ID NO: 2984 - protein, 9 aa, Homo sapiens
FCMHNEEPF

SEQ ID NO: 2985 - protein, 9 aa, Homo sapiens
QAPQHPQHL

SEQ ID NO: 2986 - protein, 9 aa, Homo sapiens
NEYDAMELL

SEQ ID NO: 2987 - protein, 9 aa, Homo sapiens
VSYNQATSL

SEQ ID NO: 2988 - protein, 9 aa, Homo sapiens
VSYNQATSL

SEQ ID NO: 2989 - protein, 9 aa, Homo sapiens
QSTPIFKML

SEQ ID NO: 2990 - protein, 9 aa, Homo sapiens
SVDSALPLY

SEQ ID NO: 2991 - protein, 9 aa, Homo sapiens
LSVDSALPL

SEQ ID NO: 2992 - protein, 9 aa, Homo sapiens
TALLDRALV

SEQ ID NO: 2993 - protein, 9 aa, Homo sapiens
IIGGFTQMI

SEQ ID NO: 2994 - protein, 9 aa, Homo sapiens
MLPEGMEMY

SEQ ID NO: 2995 - protein, 9 aa, Homo sapiens
MLPEGMEMY

SEQ ID NO: 2996 - protein, 9 aa, Homo sapiens
EGMEMYRTV

SEQ ID NO: 2997 - protein, 9 aa, Homo sapiens
KPFSEIERY

SEQ ID NO: 2998 - protein, 9 aa, Homo sapiens
KPFSEIERY

SEQ ID NO: 2999 - protein, 9 aa, Homo sapiens
YPLIALKAF

SEQ ID NO: 3000 - protein, 9 aa, Homo sapiens
YPLIALKAF

SEQ ID NO: 3001 - protein, 9 aa, Homo sapiens
KAFKKALLL

SEQ ID NO: 3002 - protein, 9 aa, Homo sapiens
HATQETPLL

SEQ ID NO: 3003 - protein, 9 aa, Homo sapiens
HATQETPLL

SEQ ID NO: 3004 - protein, 9 aa, Homo sapiens
FHQDREIRL

SEQ ID NO: 3005 - protein, 9 aa, Homo sapiens
VTLASVEER

SEQ ID NO: 3006 - protein, 9 aa, Homo sapiens
YRFVTLASV

SEQ ID NO: 3007 - protein, 9 aa, Homo sapiens
LVLDVAANR

SEQ ID NO: 3008 - protein, 9 aa, Homo sapiens
QRDDQLELI

SEQ ID NO: 3009 - protein, 9 aa, Homo sapiens
KALKDMKGR

SEQ ID NO: 3010 - protein, 9 aa, Homo sapiens
GKSANRFGR

SEQ ID NO: 3011 - protein, 9 aa, Homo sapiens
KSANRFGRR

SEQ ID NO: 3012 - protein, 9 aa, Homo sapiens
SHSNSPTDL

SEQ ID NO: 3013 - protein, 9 aa, Homo sapiens
ISFPWMLNM

SEQ ID NO: 3014 - protein, 9 aa, Homo sapiens
LLEKGFNHR

SEQ ID NO: 3015 - protein, 9 aa, Homo sapiens
ILRHHAQLL

SEQ ID NO: 3016 - protein, 9 aa, Homo sapiens
LSRAIRYYY

SEQ ID NO: 3017 - protein, 9 aa, Homo sapiens
RAIRYYYNK

SEQ ID NO: 3018 - protein, 9 aa, Homo sapiens
AIRYYYNKR

SEQ ID NO: 3019 - protein, 9 aa, Homo sapiens
LSRAIRYYY

SEQ ID NO: 3020 - protein, 9 aa, Homo sapiens
IRYYYNKRI

SEQ ID NO: 3021 - protein, 9 aa, Homo sapiens
AAVPPVSTR

SEQ ID NO: 3022 - protein, 9 aa, Homo sapiens
KTLATLTVK

SEQ ID NO: 3023 - protein, 9 aa, Homo sapiens
AHQDCVEQI

SEQ ID NO: 3024 - protein, 9 aa, Homo sapiens
SFYIPLHVK

SEQ ID NO: 3025 - protein, 9 aa, Homo sapiens
FYIPLHVKK

SEQ ID NO: 3026 - protein, 9 aa, Homo sapiens
MRRGTWLIV

SEQ ID NO: 3027 - protein, 9 aa, Homo sapiens
RRGTWLIVV

SEQ ID NO: 3028 - protein, 9 aa, Homo sapiens
TSNEQGKFI

SEQ ID NO: 3029 - protein, 9 aa, Homo sapiens
HSRTGTPER

SEQ ID NO: 3030 - protein, 9 aa, Homo sapiens
HFRKAMSIR

SEQ ID NO: 3031 - protein, 9 aa, Homo sapiens
YHFRKAMSI

SEQ ID NO: 3032 - protein, 9 aa, Homo sapiens
FTTNDSYSF

SEQ ID NO: 3033 - protein, 9 aa, Homo sapiens
DSYSFSASR

SEQ ID NO: 3034 - protein, 9 aa, Homo sapiens
SYSFSASRR

SEQ ID NO: 3035 - protein, 9 aa, Homo sapiens
FQNGCNPVL

SEQ ID NO: 3036 - protein, 9 aa, Homo sapiens
RRSHSNASV

SEQ ID NO: 3037 - protein, 9 aa, Homo sapiens
YLIAMIGNY

SEQ ID NO: 3038 - protein, 9 aa, Homo sapiens
IYFFVGYFR

SEQ ID NO: 3039 - protein, 9 aa, Homo sapiens
FFVGYFRQR

SEQ ID NO: 3040 - protein, 9 aa, Homo sapiens
GYFRQRQNR

SEQ ID NO: 3041 - protein, 9 aa, Homo sapiens
ASQGPVSLW

SEQ ID NO: 3042 - protein, 9 aa, Homo sapiens
YHCECRSSF

SEQ ID NO: 3043 - protein, 9 aa, Homo sapiens
NRKNYTSLT

SEQ ID NO: 3044 - protein, 9 aa, Homo sapiens
HTPMYFFFR

SEQ ID NO: 3045 - protein, 9 aa, Homo sapiens
MYFFFRHLS

SEQ ID NO: 3046 - protein, 9 aa, Homo sapiens
FRHLSITDL

SEQ ID NO: 3047 - protein, 9 aa, Homo sapiens
HVFRGLSSL

SEQ ID NO: 3048 - protein, 9 aa, Homo sapiens
LRNESVLDI

SEQ ID NO: 3049 - protein, 9 aa, Homo sapiens
SHLGRHPTL

SEQ ID NO: 3050 - protein, 9 aa, Homo sapiens
LAVVHALLR

SEQ ID NO: 3051 - protein, 9 aa, Homo sapiens
CKHQFCYPR

SEQ ID NO: 3052 - protein, 9 aa, Homo sapiens
AMAYLESLR

SEQ ID NO: 3053 - protein, 9 aa, Homo sapiens
VAALVSYLR

SEQ ID NO: 3054 - protein, 9 aa, Homo sapiens
SIRGLFSGR

SEQ ID NO: 3055 - protein, 9 aa, Homo sapiens
VIVAVNWTR

SEQ ID NO: 3056 - protein, 9 aa, Homo sapiens
RTRYSPIPH

SEQ ID NO: 3057 - protein, 9 aa, Homo sapiens
PHSHHQLTL

SEQ ID NO: 3058 - protein, 9 aa, Homo sapiens
YTAVAMSML

SEQ ID NO: 3059 - protein, 9 aa, Homo sapiens
TAVAMSMLY

SEQ ID NO: 3060 - protein, 9 aa, Homo sapiens
AMSMLYNTR

SEQ ID NO: 3061 - protein, 9 aa, Homo sapiens
TAVAMSMLY

SEQ ID NO: 3062 - protein, 9 aa, Homo sapiens
MSMLYNTRY

SEQ ID NO: 3063 - protein, 9 aa, Homo sapiens
KVDVYFGPR

SEQ ID NO: 3064 - protein, 9 aa, Homo sapiens
LSRKVDVYF

SEQ ID NO: 3065 - protein, 9 aa, Homo sapiens
RNGQKRSWR

SEQ ID NO: 3066 - protein, 9 aa, Homo sapiens
KRSWRRGTR

SEQ ID NO: 3067 - protein, 9 aa, Homo sapiens
FMYVKLSAK

SEQ ID NO: 3068 - protein, 9 aa, Homo sapiens
KYLLLGPWR

SEQ ID NO: 3069 - protein, 9 aa, Homo sapiens
GVQSHVCVR

SEQ ID NO: 3070 - protein, 9 aa, Homo sapiens
TATDPHCCW

SEQ ID NO: 3071 - protein, 9 aa, Homo sapiens
PYYPAYVQR

SEQ ID NO: 3072 - protein, 9 aa, Homo sapiens
TTAPPQEER

SEQ ID NO: 3073 - protein, 9 aa, Homo sapiens
VTVIAMETF

SEQ ID NO: 3074 - protein, 9 aa, Homo sapiens
ETLAAFKGY

SEQ ID NO: 3075 - protein, 9 aa, Homo sapiens
VGLQSVYER

SEQ ID NO: 3076 - protein, 9 aa, Homo sapiens
SVYERVLHR

SEQ ID NO: 3077 - protein, 9 aa, Homo sapiens
RVLHRDYDR

SEQ ID NO: 3078 - protein, 9 aa, Homo sapiens
FHLKPDTLV

SEQ ID NO: 3079 - protein, 9 aa, Homo sapiens
CEMPVNFFR

SEQ ID NO: 3080 - protein, 9 aa, Homo sapiens
AGILLIFLR

SEQ ID NO: 3081 - protein, 9 aa, Homo sapiens
MLYRNYLRR

SEQ ID NO: 3082 - protein, 9 aa, Homo sapiens
RNYLRRMRR

SEQ ID NO: 3083 - protein, 9 aa, Homo sapiens
RRMRRKSFR

SEQ ID NO: 3084 - protein, 9 aa, Homo sapiens
RMRRKSFRS

SEQ ID NO: 3085 - protein, 9 aa, Homo sapiens
LYRNYLRRM

SEQ ID NO: 3086 - protein, 9 aa, Homo sapiens
LRRMRRKSF

SEQ ID NO: 3087 - protein, 9 aa, Homo sapiens
HATHYRGPW

SEQ ID NO: 3088 - protein, 9 aa, Homo sapiens
THYRGPWYL

SEQ ID NO: 3089 - protein, 9 aa, Homo sapiens
TARRHGRYW

SEQ ID NO: 3090 - protein, 9 aa, Homo sapiens
IMKNFPYYS

SEQ ID NO: 3091 - protein, 9 aa, Homo sapiens
NLLRLWPAR

SEQ ID NO: 3092 - protein, 9 aa, Homo sapiens
QSLSVRALK

SEQ ID NO: 3093 - protein, 9 aa, Homo sapiens
LSVRALKEM

SEQ ID NO: 3094 - protein, 9 aa, Homo sapiens
EIYHTKKSY

SEQ ID NO: 3095 - protein, 9 aa, Homo sapiens
TLLEEVNYR

SEQ ID NO: 3096 - protein, 9 aa, Homo sapiens
MSHLYNHMK

SEQ ID NO: 3097 - protein, 9 aa, Homo sapiens
RSQGFAAIR

SEQ ID NO: 3098 - protein, 9 aa, Homo sapiens
GKWSYEACR

SEQ ID NO: 3099 - protein, 9 aa, Homo sapiens
SYEACRSSK

SEQ ID NO: 3100 - protein, 9 aa, Homo sapiens
DVNTARHRR

SEQ ID NO: 3101 - protein, 9 aa, Homo sapiens
LGMEPRCAR

SEQ ID NO: 3102 - protein, 9 aa, Homo sapiens
NRMPILTII

SEQ ID NO: 3103 - protein, 9 aa, Homo sapiens
DVIVHFTLH

SEQ ID NO: 3104 - protein, 9 aa, Homo sapiens
SSLQLPPPR

SEQ ID NO: 3105 - protein, 9 aa, Homo sapiens
LQLPPPRPR

SEQ ID NO: 3106 - protein, 9 aa, Homo sapiens
FNANHHLLL

SEQ ID NO: 3107 - protein, 9 aa, Homo sapiens
GTMYYESQR

SEQ ID NO: 3108 - protein, 9 aa, Homo sapiens
TARNLSCER

SEQ ID NO: 3109 - protein, 9 aa, Homo sapiens
STFSGFMVF

SEQ ID NO: 3110 - protein, 9 aa, Homo sapiens
STFSGFMVF

SEQ ID NO: 3111 - protein, 9 aa, Homo sapiens
MSLPEELSL

SEQ ID NO: 3112 - protein, 9 aa, Homo sapiens
LTEIMSSNR

SEQ ID NO: 3113 - protein, 9 aa, Homo sapiens
KTVYCHDKR

SEQ ID NO: 3114 - protein, 9 aa, Homo sapiens
TVHLQSLAR

SEQ ID NO: 3115 - protein, 9 aa, Homo sapiens
LARYTSEMR

SEQ ID NO: 3116 - protein, 9 aa, Homo sapiens
MAQLKRYYF

SEQ ID NO: 3117 - protein, 9 aa, Homo sapiens
AVSYPSAPR

SEQ ID NO: 3118 - protein, 9 aa, Homo sapiens
SVLGLGLAR

SEQ ID NO: 3119 - protein, 9 aa, Homo sapiens
NSSLILHHR

SEQ ID NO: 3120 - protein, 9 aa, Homo sapiens
HHRVHTGAR

SEQ ID NO: 3121 - protein, 9 aa, Homo sapiens
TLFPCAPVV

SEQ ID NO: 3122 - protein, 9 aa, Homo sapiens
FHGDSGPVI

SEQ ID NO: 3123 - protein, 9 aa, Homo sapiens
GRWMLAWYR

SEQ ID NO: 3124 - protein, 9 aa, Homo sapiens
WMLAWYRAR

SEQ ID NO: 3125 - protein, 9 aa, Homo sapiens
MLAWYRARR

SEQ ID NO: 3126 - protein, 9 aa, Homo sapiens
MSGRWMLAW

SEQ ID NO: 3127 - protein, 9 aa, Homo sapiens
AVNSPFVSW

SEQ ID NO: 3128 - protein, 9 aa, Homo sapiens
GTLAVQALR

SEQ ID NO: 3129 - protein, 9 aa, Homo sapiens
RMTSVLTLL

SEQ ID NO: 3130 - protein, 9 aa, Homo sapiens
MTSVLTLLF

SEQ ID NO: 3131 - protein, 9 aa, Homo sapiens
PRMTSVLTL

SEQ ID NO: 3132 - protein, 9 aa, Homo sapiens
YSHEVFFDR

SEQ ID NO: 3133 - protein, 9 aa, Homo sapiens
VTYSHEVFF

SEQ ID NO: 3134 - protein, 9 aa, Homo sapiens
VFFDRDLVL

SEQ ID NO: 3135 - protein, 9 aa, Homo sapiens
WVIKDSRGW

SEQ ID NO: 3136 - protein, 9 aa, Homo sapiens
TMSKQIFPW

SEQ ID NO: 3137 - protein, 9 aa, Homo sapiens
MAISGDFIR

SEQ ID NO: 3138 - protein, 9 aa, Homo sapiens
AISGDFIRR

SEQ ID NO: 3139 - protein, 9 aa, Homo sapiens
RSKWLWLLF

SEQ ID NO: 3140 - protein, 9 aa, Homo sapiens
LRSKWLWLL

SEQ ID NO: 3141 - protein, 9 aa, Homo sapiens
WSRERDWYR

SEQ ID NO: 3142 - protein, 9 aa, Homo sapiens
RERDWYRPR

SEQ ID NO: 3143 - protein, 9 aa, Homo sapiens
WYRPREWDR

SEQ ID NO: 3144 - protein, 9 aa, Homo sapiens
KVLEHVTLL

SEQ ID NO: 3145 - protein, 9 aa, Homo sapiens
ILCGFLSYR

SEQ ID NO: 3146 - protein, 9 aa, Homo sapiens
RVVNSKAEK

SEQ ID NO: 3147 - protein, 9 aa, Homo sapiens
VTAVLSVAR

SEQ ID NO: 3148 - protein, 9 aa, Homo sapiens
NSTRDFLLR

SEQ ID NO: 3149 - protein, 9 aa, Homo sapiens
ALSNMLQLR

SEQ ID NO: 3150 - protein, 9 aa, Homo sapiens
KSVREGGVF

SEQ ID NO: 3151 - protein, 9 aa, Homo sapiens
KILVTAWER

SEQ ID NO: 3152 - protein, 9 aa, Homo sapiens
YIPSHIQGI

SEQ ID NO: 3153 - protein, 9 aa, Homo sapiens
QFFQCIHEV

SEQ ID NO: 3154 - protein, 9 aa, Homo sapiens
DVNLWLIRY

SEQ ID NO: 3155 - protein, 9 aa, Homo sapiens
FTQEDVNLW

SEQ ID NO: 3156 - protein, 9 aa, Homo sapiens
GVKDLFVGR

SEQ ID NO: 3157 - protein, 9 aa, Homo sapiens
LAWDSRLWR

SEQ ID NO: 3158 - protein, 9 aa, Homo sapiens
DSRLWRTIR

SEQ ID NO: 3159 - protein, 9 aa, Homo sapiens
SRLWRTIRL

SEQ ID NO: 3160 - protein, 9 aa, Homo sapiens
LHHQKRGTL

SEQ ID NO: 3161 - protein, 9 aa, Homo sapiens
FSKKTAFWR

SEQ ID NO: 3162 - protein, 9 aa, Homo sapiens
ALQLVEVTR

SEQ ID NO: 3163 - protein, 9 aa, Homo sapiens
LQLVEVTRR

SEQ ID NO: 3164 - protein, 9 aa, Homo sapiens
LIIAICAVY

SEQ ID NO: 3165 - protein, 9 aa, Homo sapiens
KCNACLSSR

SEQ ID NO: 3166 - protein, 9 aa, Homo sapiens
KSKIDYGNK

SEQ ID NO: 3167 - protein, 9 aa, Homo sapiens
KVYIIAVLR

SEQ ID NO: 3168 - protein, 9 aa, Homo sapiens
IIAVLRDQR

SEQ ID NO: 3169 - protein, 9 aa, Homo sapiens
MVIVGLLVR

SEQ ID NO: 3170 - protein, 9 aa, Homo sapiens
DTFFDPISW

SEQ ID NO: 3171 - protein, 9 aa, Homo sapiens
VSCGFSSGR

SEQ ID NO: 3172 - protein, 9 aa, Homo sapiens
LVFCLIFGR

SEQ ID NO: 3173 - protein, 9 aa, Homo sapiens
FANDTSSML

SEQ ID NO: 3174 - protein, 9 aa, Homo sapiens
RIAIQSNGR

SEQ ID NO: 3175 - protein, 9 aa, Homo sapiens
FHPPRALLL

SEQ ID NO: 3176 - protein, 9 aa, Homo sapiens
GSAGSIGPR

SEQ ID NO: 3177 - protein, 9 aa, Homo sapiens
KLGAEEAAR

SEQ ID NO: 3178 - protein, 9 aa, Homo sapiens
IKYYEKYQR

SEQ ID NO: 3179 - protein, 9 aa, Homo sapiens
LTLNSVTPR

SEQ ID NO: 3180 - protein, 9 aa, Homo sapiens
EVQDIDELY

SEQ ID NO: 3181 - protein, 9 aa, Homo sapiens
KTTRSGDPF

SEQ ID NO: 3182 - protein, 9 aa, Homo sapiens
TRSGDPFII

SEQ ID NO: 3183 - protein, 9 aa, Homo sapiens
TSYKTKYYL

SEQ ID NO: 3184 - protein, 9 aa, Homo sapiens
SYKTKYYLQ

SEQ ID NO: 3185 - protein, 9 aa, Homo sapiens
SSTSPHRHR

SEQ ID NO: 3186 - protein, 9 aa, Homo sapiens
LSSTLFNHK

SEQ ID NO: 3187 - protein, 9 aa, Homo sapiens
KAFTLSSTL

SEQ ID NO: 3188 - protein, 9 aa, Homo sapiens
GARGLTGER

SEQ ID NO: 3189 - protein, 9 aa, Homo sapiens
TSLPENTVR

SEQ ID NO: 3190 - protein, 9 aa, Homo sapiens
KDLAEDATW

SEQ ID NO: 3191 - protein, 9 aa, Homo sapiens
KDLAEDAQW

SEQ ID NO: 3192 - protein, 9 aa, Homo sapiens
TSGNHVTAR

SEQ ID NO: 3193 - protein, 9 aa, Homo sapiens
SLHESSLHR

SEQ ID NO: 3194 - protein, 9 aa, Homo sapiens
VLLEFYAPR

SEQ ID NO: 3195 - protein, 9 aa, Homo sapiens
RVFLRAINR

SEQ ID NO: 3196 - protein, 9 aa, Homo sapiens
NREAHLAAV

SEQ ID NO: 3197 - protein, 9 aa, Homo sapiens
ELSKRYGGF

SEQ ID NO: 3198 - protein, 9 aa, Homo sapiens
GLKEGKYTK

SEQ ID NO: 3199 - protein, 9 aa, Homo sapiens
RMNFRRRLR

SEQ ID NO: 3200 - protein, 9 aa, Homo sapiens
FRMNFRRRL

SEQ ID NO: 3201 - protein, 9 aa, Homo sapiens
MNFRRRLRL

SEQ ID NO: 3202 - protein, 9 aa, Homo sapiens
RRRLRLMEL

SEQ ID NO: 3203 - protein, 9 aa, Homo sapiens
RRLRLMELL

SEQ ID NO: 3204 - protein, 9 aa, Homo sapiens
LAKKIISSK

SEQ ID NO: 3205 - protein, 9 aa, Homo sapiens
RALGNVFMY

SEQ ID NO: 3206 - protein, 9 aa, Homo sapiens
LTLPSAASF

SEQ ID NO: 3207 - protein, 9 aa, Homo sapiens
LVNVEGWIR

SEQ ID NO: 3208 - protein, 9 aa, Homo sapiens
GALVNVEGW

SEQ ID NO: 3209 - protein, 9 aa, Homo sapiens
LVNYEGWIR

SEQ ID NO: 3210 - protein, 9 aa, Homo sapiens
GALVNYEGW

SEQ ID NO: 3211 - protein, 9 aa, Homo sapiens
LQLDNPTYM

SEQ ID NO: 3212 - protein, 9 aa, Homo sapiens
KEFLRLQRR

SEQ ID NO: 3213 - protein, 9 aa, Homo sapiens
MRQGRSLLH

SEQ ID NO: 3214 - protein, 9 aa, Homo sapiens
EPPEVIGPM

SEQ ID NO: 3215 - protein, 9 aa, Homo sapiens
EVIGPMRPE

SEQ ID NO: 3216 - protein, 9 aa, Homo sapiens
RRYVEPPEV

SEQ ID NO: 3217 - protein, 9 aa, Homo sapiens
SLNLFVVNK

SEQ ID NO: 3218 - protein, 9 aa, Homo sapiens
RCLSLKNAK

SEQ ID NO: 3219 - protein, 9 aa, Homo sapiens
GSGKSTILR

SEQ ID NO: 3220 - protein, 9 aa, Homo sapiens
STILRLLFR

SEQ ID NO: 3221 - protein, 9 aa, Homo sapiens
KSTILRLLF

SEQ ID NO: 3222 - protein, 9 aa, Homo sapiens
ISTPVPPTR

SEQ ID NO: 3223 - protein, 9 aa, Homo sapiens
TRSELAENL

SEQ ID NO: 3224 - protein, 9 aa, Homo sapiens
RHEDGRRGL

SEQ ID NO: 3225 - protein, 9 aa, Homo sapiens
TSWAALALL

SEQ ID NO: 3226 - protein, 9 aa, Homo sapiens
GSSSNEEEW

SEQ ID NO: 3227 - protein, 9 aa, Homo sapiens
HFVGTEIIR

SEQ ID NO: 3228 - protein, 9 aa, Homo sapiens
AYYLVKRKK

SEQ ID NO: 3229 - protein, 9 aa, Homo sapiens
SRLPALQIF

SEQ ID NO: 3230 - protein, 9 aa, Homo sapiens
SQLVATTAR

SEQ ID NO: 3231 - protein, 9 aa, Homo sapiens
QHRDHIVVV

SEQ ID NO: 3232 - protein, 9 aa, Homo sapiens
IIIIIVWFV

SEQ ID NO: 3233 - protein, 9 aa, Homo sapiens
CLLLGGLSV

SEQ ID NO: 3234 - protein, 9 aa, Homo sapiens
KDFNNSSHL

SEQ ID NO: 3235 - protein, 9 aa, Homo sapiens
TPRAGLGHI

SEQ ID NO: 3236 - protein, 9 aa, Homo sapiens
SRLGHSSIF

SEQ ID NO: 3237 - protein, 9 aa, Homo sapiens
SVVHRFAHL

SEQ ID NO: 3238 - protein, 9 aa, Homo sapiens
VVHRFAHLL

SEQ ID NO: 3239 - protein, 9 aa, Homo sapiens
SVMKKCRNL

SEQ ID NO: 3240 - protein, 9 aa, Homo sapiens
MMTCEQTQL

SEQ ID NO: 3241 - protein, 9 aa, Homo sapiens
MTCEQTQLL

SEQ ID NO: 3242 - protein, 9 aa, Homo sapiens
MTCEQTQLL

SEQ ID NO: 3243 - protein, 9 aa, Homo sapiens
AMVYYMPTT

SEQ ID NO: 3244 - protein, 9 aa, Homo sapiens
MVYYMPTTI

SEQ ID NO: 3245 - protein, 9 aa, Homo sapiens
YMPTTIIAA

SEQ ID NO: 3246 - protein, 9 aa, Homo sapiens
MVYYMPTTI

SEQ ID NO: 3247 - protein, 9 aa, Homo sapiens
VYYMPTTII

SEQ ID NO: 3248 - protein, 9 aa, Homo sapiens
MPTTIIAAV

SEQ ID NO: 3249 - protein, 9 aa, Homo sapiens
SPPPCPPVI

SEQ ID NO: 3250 - protein, 9 aa, Homo sapiens
HLAVILPRI

SEQ ID NO: 3251 - protein, 9 aa, Homo sapiens
QRGDHLAVI

SEQ ID NO: 3252 - protein, 9 aa, Homo sapiens
QRGDHLAVI

SEQ ID NO: 3253 - protein, 9 aa, Homo sapiens
SIIHFPDAL

SEQ ID NO: 3254 - protein, 9 aa, Homo sapiens
IHFPDALEM

SEQ ID NO: 3255 - protein, 9 aa, Homo sapiens
IHFPDALEM

SEQ ID NO: 3256 - protein, 9 aa, Homo sapiens
GIMFSSFMA

SEQ ID NO: 3257 - protein, 9 aa, Homo sapiens
IMFSSFMAA

SEQ ID NO: 3258 - protein, 9 aa, Homo sapiens
TPVELYYAV

SEQ ID NO: 3259 - protein, 9 aa, Homo sapiens
YAVHPGNER

SEQ ID NO: 3260 - protein, 9 aa, Homo sapiens
NTFDLVALW

SEQ ID NO: 3261 - protein, 9 aa, Homo sapiens
VALWVGSTL

SEQ ID NO: 3262 - protein, 9 aa, Homo sapiens
KLNTITAVV

SEQ ID NO: 3263 - protein, 9 aa, Homo sapiens
AILQLVRMY

SEQ ID NO: 3264 - protein, 9 aa, Homo sapiens
VRMYKKLKV

SEQ ID NO: 3265 - protein, 9 aa, Homo sapiens
RAILQLVRM

SEQ ID NO: 3266 - protein, 9 aa, Homo sapiens
RQPEPPPLV

SEQ ID NO: 3267 - protein, 9 aa, Homo sapiens
RQPEPPPLV

SEQ ID NO: 3268 - protein, 9 aa, Homo sapiens
IGNSNEDVY

SEQ ID NO: 3269 - protein, 9 aa, Homo sapiens
VLSGLEATV

SEQ ID NO: 3270 - protein, 9 aa, Homo sapiens
GLEATVEHV

SEQ ID NO: 3271 - protein, 9 aa, Homo sapiens
LEATVEHVY

SEQ ID NO: 3272 - protein, 9 aa, Homo sapiens
ALLAINYTS

SEQ ID NO: 3273 - protein, 9 aa, Homo sapiens
LAINYTSEL

SEQ ID NO: 3274 - protein, 9 aa, Homo sapiens
YIERCLAHL

SEQ ID NO: 3275 - protein, 9 aa, Homo sapiens
YIERCLAHL

SEQ ID NO: 3276 - protein, 9 aa, Homo sapiens
MADRDEARL

SEQ ID NO: 3277 - protein, 9 aa, Homo sapiens
GSDSDESGY

SEQ ID NO: 3278 - protein, 9 aa, Homo sapiens
DSDESGYKV

SEQ ID NO: 3279 - protein, 9 aa, Homo sapiens
PEFECSGIV

SEQ ID NO: 3280 - protein, 9 aa, Homo sapiens
MKYECLARI

SEQ ID NO: 3281 - protein, 9 aa, Homo sapiens
MKYECLARI

SEQ ID NO: 3282 - protein, 9 aa, Homo sapiens
HAQDKEPEL

SEQ ID NO: 3283 - protein, 9 aa, Homo sapiens
KRHERVTVK

SEQ ID NO: 3284 - protein, 9 aa, Homo sapiens
NCNECGKSF

SEQ ID NO: 3285 - protein, 9 aa, Homo sapiens
LRRELTDRL

SEQ ID NO: 3286 - protein, 9 aa, Homo sapiens
LAAAKCRNL

SEQ ID NO: 3287 - protein, 9 aa, Homo sapiens
VTRNPHKMM

SEQ ID NO: 3288 - protein, 9 aa, Homo sapiens
RVARNARVL

SEQ ID NO: 3289 - protein, 9 aa, Homo sapiens
VTLSHAHEV

SEQ ID NO: 3290 - protein, 9 aa, Homo sapiens
VTLSHAHEV

SEQ ID NO: 3291 - protein, 9 aa, Homo sapiens
VTLSHAHEV

SEQ ID NO: 3292 - protein, 9 aa, Homo sapiens
MVAQPPRGI

SEQ ID NO: 3293 - protein, 9 aa, Homo sapiens
YVNSHSLIV

SEQ ID NO: 3294 - protein, 9 aa, Homo sapiens
IVWVCDRSY

SEQ ID NO: 3295 - protein, 9 aa, Homo sapiens
YVNSHSLIV

SEQ ID NO: 3296 - protein, 9 aa, Homo sapiens
YVNSHSLIV

SEQ ID NO: 3297 - protein, 9 aa, Homo sapiens
VTPEGLQVV

SEQ ID NO: 3298 - protein, 9 aa, Homo sapiens
RLEHLDLSY

SEQ ID NO: 3299 - protein, 9 aa, Homo sapiens
DSFSSLGRL

SEQ ID NO: 3300 - protein, 9 aa, Homo sapiens
ALITILLCI

SEQ ID NO: 3301 - protein, 9 aa, Homo sapiens
LSTGALITI

SEQ ID NO: 3302 - protein, 9 aa, Homo sapiens
SPFYSSSPV

SEQ ID NO: 3303 - protein, 9 aa, Homo sapiens
QLFTFHEVV

SEQ ID NO: 3304 - protein, 9 aa, Homo sapiens
FHEVVSQMV

SEQ ID NO: 3305 - protein, 9 aa, Homo sapiens
QLFTFHEVV

SEQ ID NO: 3306 - protein, 9 aa, Homo sapiens
FTFHEVVSQ

SEQ ID NO: 3307 - protein, 9 aa, Homo sapiens
FHEVVSQMV

SEQ ID NO: 3308 - protein, 9 aa, Homo sapiens
MIATVHLKV

SEQ ID NO: 3309 - protein, 9 aa, Homo sapiens
TLRKRLYEV

SEQ ID NO: 3310 - protein, 9 aa, Homo sapiens
TLRKRLYEV

SEQ ID NO: 3311 - protein, 9 aa, Homo sapiens
STRTCPRDY

SEQ ID NO: 3312 - protein, 9 aa, Homo sapiens
VQCSTSLYV

SEQ ID NO: 3313 - protein, 9 aa, Homo sapiens
STSLYVSLV

SEQ ID NO: 3314 - protein, 9 aa, Homo sapiens
SLYVSLVTL

SEQ ID NO: 3315 - protein, 9 aa, Homo sapiens
SLYVSLVTL

SEQ ID NO: 3316 - protein, 9 aa, Homo sapiens
QKHPRFSQL

SEQ ID NO: 3317 - protein, 9 aa, Homo sapiens
FTTFNIRKV

SEQ ID NO: 3318 - protein, 9 aa, Homo sapiens
FTTFNIRKV

SEQ ID NO: 3319 - protein, 9 aa, Homo sapiens
KVIAVTLDL

SEQ ID NO: 3320 - protein, 9 aa, Homo sapiens
FSGKKVIAV

SEQ ID NO: 3321 - protein, 9 aa, Homo sapiens
FSGKKVIAV

SEQ ID NO: 3322 - protein, 9 aa, Homo sapiens
LISASIFHL

SEQ ID NO: 3323 - protein, 9 aa, Homo sapiens
TAIPVFHAV

SEQ ID NO: 3324 - protein, 9 aa, Homo sapiens
TAIPVFHAV

SEQ ID NO: 3325 - protein, 9 aa, Homo sapiens
KHFKNCASI

SEQ ID NO: 3326 - protein, 9 aa, Homo sapiens
KHFKNCASI

SEQ ID NO: 3327 - protein, 9 aa, Homo sapiens
KHFKNCASI

SEQ ID NO: 3328 - protein, 9 aa, Homo sapiens
LMPYCKSLV

SEQ ID NO: 3329 - protein, 9 aa, Homo sapiens
MPYCKSLVI

SEQ ID NO: 3330 - protein, 9 aa, Homo sapiens
MPYCKSLVI

SEQ ID NO: 3331 - protein, 9 aa, Homo sapiens
FSLSSPSPL

SEQ ID NO: 3332 - protein, 9 aa, Homo sapiens
TEFSAGSIV

SEQ ID NO: 3333 - protein, 9 aa, Homo sapiens
TEFSAGSIV

SEQ ID NO: 3334 - protein, 9 aa, Homo sapiens
HVTWRTPDY

SEQ ID NO: 3335 - protein, 9 aa, Homo sapiens
NIMSTPLPA

SEQ ID NO: 3336 - protein, 9 aa, Homo sapiens
IMSTPLPAI

SEQ ID NO: 3337 - protein, 9 aa, Homo sapiens
CAVPISTSF

SEQ ID NO: 3338 - protein, 9 aa, Homo sapiens
ISTSFIKQI

SEQ ID NO: 3339 - protein, 9 aa, Homo sapiens
FIKQIATKV

SEQ ID NO: 3340 - protein, 9 aa, Homo sapiens
FLLGTLALG

SEQ ID NO: 3341 - protein, 9 aa, Homo sapiens
LLGTLALGV

SEQ ID NO: 3342 - protein, 9 aa, Homo sapiens
LGTLALGVY

SEQ ID NO: 3343 - protein, 9 aa, Homo sapiens
AIPEKYWAV

SEQ ID NO: 3344 - protein, 9 aa, Homo sapiens
RHKGYLGAI

SEQ ID NO: 3345 - protein, 9 aa, Homo sapiens
QAKNQAYAI

SEQ ID NO: 3346 - protein, 9 aa, Homo sapiens
WMASESWAI

SEQ ID NO: 3347 - protein, 9 aa, Homo sapiens
LPPDLCLPF

SEQ ID NO: 3348 - protein, 9 aa, Homo sapiens
MNMHKIYTV

SEQ ID NO: 3349 - protein, 9 aa, Homo sapiens
NMHKIYTVL

SEQ ID NO: 3350 - protein, 9 aa, Homo sapiens
SVMNMHKIY

SEQ ID NO: 3351 - protein, 9 aa, Homo sapiens
MNMHKIYTV

SEQ ID NO: 3352 - protein, 9 aa, Homo sapiens
LLAKKRRQA

SEQ ID NO: 3353 - protein, 9 aa, Homo sapiens
LAKKRRQAR

SEQ ID NO: 3354 - protein, 9 aa, Homo sapiens
DRLQAANLL

SEQ ID NO: 3355 - protein, 9 aa, Homo sapiens
CTNRAAAQY

SEQ ID NO: 3356 - protein, 9 aa, Homo sapiens
QMAEVTKIY

SEQ ID NO: 3357 - protein, 9 aa, Homo sapiens
FTINNGTGL

SEQ ID NO: 3358 - protein, 9 aa, Homo sapiens
QVFKLSTCY

SEQ ID NO: 3359 - protein, 9 aa, Homo sapiens
THAEAQASI

SEQ ID NO: 3360 - protein, 9 aa, Homo sapiens
KIDTQDQSY

SEQ ID NO: 3361 - protein, 9 aa, Homo sapiens
DTQDQSYHY

SEQ ID NO: 3362 - protein, 9 aa, Homo sapiens
SHYGKIDTQ

SEQ ID NO: 3363 - protein, 9 aa, Homo sapiens
DTQHQSSHY

SEQ ID NO: 3364 - protein, 9 aa, Homo sapiens
YHYGHTDRQ

SEQ ID NO: 3365 - protein, 9 aa, Homo sapiens
THSGHTHCQ

SEQ ID NO: 3366 - protein, 9 aa, Homo sapiens
SSSGQYSGY

SEQ ID NO: 3367 - protein, 9 aa, Homo sapiens
SPAQCVPPA

SEQ ID NO: 3368 - protein, 9 aa, Homo sapiens
STNINNQEI

SEQ ID NO: 3369 - protein, 9 aa, Homo sapiens
INNQEIQEL

SEQ ID NO: 3370 - protein, 9 aa, Homo sapiens
YSLERDKLI

SEQ ID NO: 3371 - protein, 9 aa, Homo sapiens
LPVMKLSCI

SEQ ID NO: 3372 - protein, 9 aa, Homo sapiens
CTSQYFLSY

SEQ ID NO: 3373 - protein, 9 aa, Homo sapiens
CTSQYFLSY

SEQ ID NO: 3374 - protein, 9 aa, Homo sapiens
YHLDIPLNT

SEQ ID NO: 3375 - protein, 9 aa, Homo sapiens
YDQDALRVL

SEQ ID NO: 3376 - protein, 9 aa, Homo sapiens
KADTKAQTY

SEQ ID NO: 3377 - protein, 9 aa, Homo sapiens
TYIDSPQNL

SEQ ID NO: 3378 - protein, 9 aa, Homo sapiens
CPTCRKKLL

SEQ ID NO: 3379 - protein, 9 aa, Homo sapiens
LAEGDALRY

SEQ ID NO: 3380 - protein, 9 aa, Homo sapiens
LAEGDALRY

SEQ ID NO: 3381 - protein, 9 aa, Homo sapiens
SHLTRHKRI

SEQ ID NO: 3382 - protein, 9 aa, Homo sapiens
TRHKRIHTG

SEQ ID NO: 3383 - protein, 9 aa, Homo sapiens
FAVYDESAT

SEQ ID NO: 3384 - protein, 9 aa, Homo sapiens
FLVPISISY

SEQ ID NO: 3385 - protein, 9 aa, Homo sapiens
QPGPLTVEL

SEQ ID NO: 3386 - protein, 9 aa, Homo sapiens
SVLTKHKRI

SEQ ID NO: 3387 - protein, 9 aa, Homo sapiens
HVKLIVDAF

SEQ ID NO: 3388 - protein, 9 aa, Homo sapiens
STGSHVKLI

SEQ ID NO: 3389 - protein, 9 aa, Homo sapiens
YPFFLGVTI

SEQ ID NO: 3390 - protein, 9 aa, Homo sapiens
TTKPKSLSA

SEQ ID NO: 3391 - protein, 9 aa, Homo sapiens
SSSDTVKIL

SEQ ID NO: 3392 - protein, 9 aa, Homo sapiens
LIASKFQNF

SEQ ID NO: 3393 - protein, 9 aa, Homo sapiens
MHNNAVVKM

SEQ ID NO: 3394 - protein, 9 aa, Homo sapiens
SRLAYKYVI

SEQ ID NO: 3395 - protein, 9 aa, Homo sapiens
SNMMRAAAE

SEQ ID NO: 3396 - protein, 9 aa, Homo sapiens
NMMRAAAEL

SEQ ID NO: 3397 - protein, 9 aa, Homo sapiens
SRARDSNMM

SEQ ID NO: 3398 - protein, 9 aa, Homo sapiens
MRAAAELAL

SEQ ID NO: 3399 - protein, 9 aa, Homo sapiens
YPSYSHCVG

SEQ ID NO: 3400 - protein, 9 aa, Homo sapiens
SHCVGRISV

SEQ ID NO: 3401 - protein, 9 aa, Homo sapiens
FPPCAIKYF

SEQ ID NO: 3402 - protein, 9 aa, Homo sapiens
YLFKESLVF

SEQ ID NO: 3403 - protein, 9 aa, Homo sapiens
DRRQKLIYL

SEQ ID NO: 3404 - protein, 9 aa, Homo sapiens
LRPGHLEML

SEQ ID NO: 3405 - protein, 9 aa, Homo sapiens
EAHAESPSL

SEQ ID NO: 3406 - protein, 9 aa, Homo sapiens
LVARSPGPY

SEQ ID NO: 3407 - protein, 9 aa, Homo sapiens
LVARSPGPY

SEQ ID NO: 3408 - protein, 9 aa, Homo sapiens
DRGPCAVFL

SEQ ID NO: 3409 - protein, 9 aa, Homo sapiens
NVIPHTYCY

SEQ ID NO: 3410 - protein, 9 aa, Homo sapiens
IPHTYCYHM

SEQ ID NO: 3411 - protein, 9 aa, Homo sapiens
KHYPRGTHL

SEQ ID NO: 3412 - protein, 9 aa, Homo sapiens
ERSQGTEEV

SEQ ID NO: 3413 - protein, 9 aa, Homo sapiens
SLAPRILFY

SEQ ID NO: 3414 - protein, 9 aa, Homo sapiens
IHSSLAPRI

SEQ ID NO: 3415 - protein, 9 aa, Homo sapiens
LSDTKTISY

SEQ ID NO: 3416 - protein, 9 aa, Homo sapiens
LSDTKTISY

SEQ ID NO: 3417 - protein, 9 aa, Homo sapiens
VLMLFLTIL

SEQ ID NO: 3418 - protein, 9 aa, Homo sapiens
FSTEIVVLM

SEQ ID NO: 3419 - protein, 9 aa, Homo sapiens
FSTEIVVLM

SEQ ID NO: 3420 - protein, 9 aa, Homo sapiens
SHGTMSILM

SEQ ID NO: 3421 - protein, 9 aa, Homo sapiens
LANGEVHIY

SEQ ID NO: 3422 - protein, 9 aa, Homo sapiens
VHIYRDKAL

SEQ ID NO: 3423 - protein, 9 aa, Homo sapiens
LPEMAIVGL

SEQ ID NO: 3424 - protein, 9 aa, Homo sapiens
LPTAKRKSV

SEQ ID NO: 3425 - protein, 9 aa, Homo sapiens
IPVDCAVAV

SEQ ID NO: 3426 - protein, 9 aa, Homo sapiens
YPGMRSKEL

SEQ ID NO: 3427 - protein, 9 aa, Homo sapiens
YPGMRSKEL

SEQ ID NO: 3428 - protein, 9 aa, Homo sapiens
MRSKELTKI

SEQ ID NO: 3429 - protein, 9 aa, Homo sapiens
SDKEHEQEL

SEQ ID NO: 3430 - protein, 9 aa, Homo sapiens
SRMSFRLSF

SEQ ID NO: 3431 - protein, 9 aa, Homo sapiens
SFRLSFASL

SEQ ID NO: 3432 - protein, 9 aa, Homo sapiens
LSFASLFSF

SEQ ID NO: 3433 - protein, 9 aa, Homo sapiens
SRMSFRLSF

SEQ ID NO: 3434 - protein, 9 aa, Homo sapiens
FRLSFASLF

SEQ ID NO: 3435 - protein, 9 aa, Homo sapiens
AAAAAPPGF

SEQ ID NO: 3436 - protein, 9 aa, Homo sapiens
FRLRLLLLL

SEQ ID NO: 3437 - protein, 9 aa, Homo sapiens
FRKAVVLTL

SEQ ID NO: 3438 - protein, 9 aa, Homo sapiens
MLNPLIYSM

SEQ ID NO: 3439 - protein, 9 aa, Homo sapiens
SMRNKDVKV

SEQ ID NO: 3440 - protein, 9 aa, Homo sapiens
MLNPLIYSM

SEQ ID NO: 3441 - protein, 9 aa, Homo sapiens
FLRIKRSVK

SEQ ID NO: 3442 - protein, 9 aa, Homo sapiens
RIKRSVKSV

SEQ ID NO: 3443 - protein, 9 aa, Homo sapiens
KRSVKSVVL

SEQ ID NO: 3444 - protein, 9 aa, Homo sapiens
GHCARQREV

SEQ ID NO: 3445 - protein, 9 aa, Homo sapiens
SRSASGRNI

SEQ ID NO: 3446 - protein, 9 aa, Homo sapiens
VYIDETRQM

SEQ ID NO: 3447 - protein, 9 aa, Homo sapiens
YIDETRQML

SEQ ID NO: 3448 - protein, 9 aa, Homo sapiens
YLKLHFLID

SEQ ID NO: 3449 - protein, 9 aa, Homo sapiens
THGKEMDLM

SEQ ID NO: 3450 - protein, 9 aa, Homo sapiens
FPGQLAGTT

SEQ ID NO: 3451 - protein, 9 aa, Homo sapiens
KARKYLHSL

SEQ ID NO: 3452 - protein, 9 aa, Homo sapiens
ARKYLHSLM

SEQ ID NO: 3453 - protein, 9 aa, Homo sapiens
FLRKFIAYF

SEQ ID NO: 3454 - protein, 9 aa, Homo sapiens
VQDLRSDLY

SEQ ID NO: 3455 - protein, 9 aa, Homo sapiens
LAGLLTIAM

SEQ ID NO: 3456 - protein, 9 aa, Homo sapiens
LLTTRDKSL

SEQ ID NO: 3457 - protein, 9 aa, Homo sapiens
IPFAARVHY

SEQ ID NO: 3458 - protein, 9 aa, Homo sapiens
QPTETRFVH

SEQ ID NO: 3459 - protein, 9 aa, Homo sapiens
TRFVHGRAI

SEQ ID NO: 3460 - protein, 9 aa, Homo sapiens
FFNYKKMTI

SEQ ID NO: 3461 - protein, 9 aa, Homo sapiens
ENKIRGLCL

SEQ ID NO: 3462 - protein, 9 aa, Homo sapiens
ERFDALTDL

SEQ ID NO: 3463 - protein, 9 aa, Homo sapiens
WPQKVLDIL

SEQ ID NO: 3464 - protein, 9 aa, Homo sapiens
LPIGIPDYM

SEQ ID NO: 3465 - protein, 9 aa, Homo sapiens
FNYKNRQNL

SEQ ID NO: 3466 - protein, 9 aa, Homo sapiens
NRQNLDEIL

SEQ ID NO: 3467 - protein, 9 aa, Homo sapiens
IGWMSSHTY

SEQ ID NO: 3468 - protein, 9 aa, Homo sapiens
KRAAGVQLI

SEQ ID NO: 3469 - protein, 9 aa, Homo sapiens
YPTRNSMVM

SEQ ID NO: 3470 - protein, 9 aa, Homo sapiens
IFEDRGQEL

SEQ ID NO: 3471 - protein, 9 aa, Homo sapiens
MRIHTGEKL

SEQ ID NO: 3472 - protein, 9 aa, Homo sapiens
VHQRSHTGV

SEQ ID NO: 3473 - protein, 9 aa, Homo sapiens
SHTGVKPYV

SEQ ID NO: 3474 - protein, 9 aa, Homo sapiens
IIHMRIHSG

SEQ ID NO: 3475 - protein, 9 aa, Homo sapiens
IIHMRTHTG

SEQ ID NO: 3476 - protein, 9 aa, Homo sapiens
SPAFKVTEF

SEQ ID NO: 3477 - protein, 9 aa, Homo sapiens
LARALPVAF

SEQ ID NO: 3478 - protein, 9 aa, Homo sapiens
LPVAFPTGA

SEQ ID NO: 3479 - protein, 9 aa, Homo sapiens
LNFLRTHQL

SEQ ID NO: 3480 - protein, 9 aa, Homo sapiens
SAAQRGHSM

SEQ ID NO: 3481 - protein, 9 aa, Homo sapiens
SAAQRGHSM

SEQ ID NO: 3482 - protein, 9 aa, Homo sapiens
SAAQRGHSM

SEQ ID NO: 3483 - protein, 9 aa, Homo sapiens
GHSMLSWSL

SEQ ID NO: 3484 - protein, 9 aa, Homo sapiens
VRKNQILII

SEQ ID NO: 3485 - protein, 9 aa, Homo sapiens
EALKKCGVL

SEQ ID NO: 3486 - protein, 9 aa, Homo sapiens
AHGHAREAV

SEQ ID NO: 3487 - protein, 9 aa, Homo sapiens
WLQAHYQEA

SEQ ID NO: 3488 - protein, 9 aa, Homo sapiens
QALWLQAHY

SEQ ID NO: 3489 - protein, 9 aa, Homo sapiens
GPGTYTLPL

SEQ ID NO: 3490 - protein, 9 aa, Homo sapiens
IHPDGEKVV

SEQ ID NO: 3491 - protein, 9 aa, Homo sapiens
THSAKDGKL

SEQ ID NO: 3492 - protein, 9 aa, Homo sapiens
DLIDEDLSF

SEQ ID NO: 3493 - protein, 9 aa, Homo sapiens
LVSECNYEH

SEQ ID NO: 3494 - protein, 9 aa, Homo sapiens
EHWHKQRRV

SEQ ID NO: 3495 - protein, 9 aa, Homo sapiens
SEKQKLRAL

SEQ ID NO: 3496 - protein, 9 aa, Homo sapiens
MIQIREVHM

SEQ ID NO: 3497 - protein, 9 aa, Homo sapiens
EVHMRFISE

SEQ ID NO: 3498 - protein, 9 aa, Homo sapiens
IREVHMRFI

SEQ ID NO: 3499 - protein, 9 aa, Homo sapiens
VHMRFISEL

SEQ ID NO: 3500 - protein, 9 aa, Homo sapiens
DASADRVAL

SEQ ID NO: 3501 - protein, 9 aa, Homo sapiens
GPGSIPLQY

SEQ ID NO: 3502 - protein, 9 aa, Homo sapiens
PLALRLRAL

SEQ ID NO: 3503 - protein, 9 aa, Homo sapiens
FPLALRLRA

SEQ ID NO: 3504 - protein, 9 aa, Homo sapiens
VPLDSYCNY

SEQ ID NO: 3505 - protein, 9 aa, Homo sapiens
YCNYRSAEY

SEQ ID NO: 3506 - protein, 9 aa, Homo sapiens
LVSGPDPAF

SEQ ID NO: 3507 - protein, 9 aa, Homo sapiens
RSFSGGQLV

SEQ ID NO: 3508 - protein, 9 aa, Homo sapiens
YRHDARAFF

SEQ ID NO: 3509 - protein, 9 aa, Homo sapiens
TLLKGFKIL

SEQ ID NO: 3510 - protein, 9 aa, Homo sapiens
VGNYFHMAY

SEQ ID NO: 3511 - protein, 9 aa, Homo sapiens
GSAIAYCAY

SEQ ID NO: 3512 - protein, 9 aa, Homo sapiens
CAYTFPDAL

SEQ ID NO: 3513 - protein, 9 aa, Homo sapiens
LPQKVARVF

SEQ ID NO: 3514 - protein, 9 aa, Homo sapiens
TRRILPQKV

SEQ ID NO: 3515 - protein, 9 aa, Homo sapiens
YFVNRFSSL

SEQ ID NO: 3516 - protein, 9 aa, Homo sapiens
PRLECSGVV

SEQ ID NO: 3517 - protein, 9 aa, Homo sapiens
FIVSKKPPL

SEQ ID NO: 3518 - protein, 9 aa, Homo sapiens
RRLGLVSAV

SEQ ID NO: 3519 - protein, 9 aa, Homo sapiens
QIREKLHQL

SEQ ID NO: 3520 - protein, 9 aa, Homo sapiens
LPRCLRTAV

SEQ ID NO: 3521 - protein, 9 aa, Homo sapiens
LPRCLRTAV

SEQ ID NO: 3522 - protein, 9 aa, Homo sapiens
IHFFLPRCL

SEQ ID NO: 3523 - protein, 9 aa, Homo sapiens
RLQKRGQQV

SEQ ID NO: 3524 - protein, 9 aa, Homo sapiens
EPGSKGFGF

SEQ ID NO: 3525 - protein, 9 aa, Homo sapiens
GRGAGRELV

SEQ ID NO: 3526 - protein, 9 aa, Homo sapiens
LHREDAFHI

SEQ ID NO: 3527 - protein, 9 aa, Homo sapiens
HREDAFHIF

SEQ ID NO: 3528 - protein, 9 aa, Homo sapiens
VPLLAGQLF

SEQ ID NO: 3529 - protein, 9 aa, Homo sapiens
LPWFTHITS

SEQ ID NO: 3530 - protein, 9 aa, Homo sapiens
SRLPWFTHI

SEQ ID NO: 3531 - protein, 9 aa, Homo sapiens
HLDAMFRAF

SEQ ID NO: 3532 - protein, 9 aa, Homo sapiens
EMYTHVTCA

SEQ ID NO: 3533 - protein, 9 aa, Homo sapiens
AHKEMYTHV

SEQ ID NO: 3534 - protein, 9 aa, Homo sapiens
FPTQRSHSI

SEQ ID NO: 3535 - protein, 9 aa, Homo sapiens
FPTQRSHSI

SEQ ID NO: 3536 - protein, 9 aa, Homo sapiens
LRKVRLNEI

SEQ ID NO: 3537 - protein, 9 aa, Homo sapiens
NRVKSLRKV

SEQ ID NO: 3538 - protein, 9 aa, Homo sapiens
LRKVRLNEI

SEQ ID NO: 3539 - protein, 9 aa, Homo sapiens
FVTVQGRAF

SEQ ID NO: 3540 - protein, 9 aa, Homo sapiens
NRMLTSGLV

SEQ ID NO: 3541 - protein, 9 aa, Homo sapiens
RARLRLCGV

SEQ ID NO: 3542 - protein, 9 aa, Homo sapiens
FRENQQITI

SEQ ID NO: 3543 - protein, 9 aa, Homo sapiens
SYWPTSPSY

SEQ ID NO: 3544 - protein, 9 aa, Homo sapiens
YVIEYAACH

SEQ ID NO: 3545 - protein, 9 aa, Homo sapiens
EYAACHATY

SEQ ID NO: 3546 - protein, 9 aa, Homo sapiens
CHATYNEIV

SEQ ID NO: 3547 - protein, 9 aa, Homo sapiens
VRGPYITAL

SEQ ID NO: 3548 - protein, 9 aa, Homo sapiens
FPASVPIGA

SEQ ID NO: 3549 - protein, 9 aa, Homo sapiens
EHELVLQQL

SEQ ID NO: 3550 - protein, 9 aa, Homo sapiens
MPMGGIMPP

SEQ ID NO: 3551 - protein, 9 aa, Homo sapiens
IHKGVYQKL

SEQ ID NO: 3552 - protein, 9 aa, Homo sapiens
LERPRGVPL

SEQ ID NO: 3553 - protein, 9 aa, Homo sapiens
RRLERPRGV

SEQ ID NO: 3554 - protein, 9 aa, Homo sapiens
SLKEYYTLM

SEQ ID NO: 3555 - protein, 9 aa, Homo sapiens
SLRLQSYSA

SEQ ID NO: 3556 - protein, 9 aa, Homo sapiens
PRSALSRLL

SEQ ID NO: 3557 - protein, 9 aa, Homo sapiens
SRLLLPLLL

SEQ ID NO: 3558 - protein, 9 aa, Homo sapiens
LYSPNPEEL

SEQ ID NO: 3559 - protein, 9 aa, Homo sapiens
HLQQKQQDL

SEQ ID NO: 3560 - protein, 9 aa, Homo sapiens
RDQDRGQHL

SEQ ID NO: 3561 - protein, 9 aa, Homo sapiens
YPSFADLIH

SEQ ID NO: 3562 - protein, 9 aa, Homo sapiens
FWWGEYPSF

SEQ ID NO: 3563 - protein, 9 aa, Homo sapiens
CALPYHEVF

SEQ ID NO: 3564 - protein, 9 aa, Homo sapiens
LPYHEVFTI

SEQ ID NO: 3565 - protein, 9 aa, Homo sapiens
NPGSKLSQL

SEQ ID NO: 3566 - protein, 9 aa, Homo sapiens
FAMARLHFL

SEQ ID NO: 3567 - protein, 9 aa, Homo sapiens
MARLHFLKL

SEQ ID NO: 3568 - protein, 9 aa, Homo sapiens
FAMARLHFL

SEQ ID NO: 3569 - protein, 9 aa, Homo sapiens
SSRKRHTAG

SEQ ID NO: 3570 - protein, 9 aa, Homo sapiens
AHACNTSTL

SEQ ID NO: 3571 - protein, 9 aa, Homo sapiens
LPDKFSPAV

SEQ ID NO: 3572 - protein, 9 aa, Homo sapiens
SPALHDREL

SEQ ID NO: 3573 - protein, 9 aa, Homo sapiens
FPANCDACS

SEQ ID NO: 3574 - protein, 9 aa, Homo sapiens
YSILQGQLY

SEQ ID NO: 3575 - protein, 9 aa, Homo sapiens
YSILQGQLY

SEQ ID NO: 3576 - protein, 9 aa, Homo sapiens
YLRFLDCEM

SEQ ID NO: 3577 - protein, 9 aa, Homo sapiens
HPNQVSPAK

SEQ ID NO: 3578 - protein, 9 aa, Homo sapiens
NPIHSTSAM

SEQ ID NO: 3579 - protein, 9 aa, Homo sapiens
SIMDMRSRV

SEQ ID NO: 3580 - protein, 9 aa, Homo sapiens
RHHDGSVDF

SEQ ID NO: 3581 - protein, 9 aa, Homo sapiens
TAISKFLFL

SEQ ID NO: 3582 - protein, 9 aa, Homo sapiens
YEMGLGKTI

SEQ ID NO: 3583 - protein, 9 aa, Homo sapiens
PAFPAKDPY

SEQ ID NO: 3584 - protein, 9 aa, Homo sapiens
FPAKDPYPP

SEQ ID NO: 3585 - protein, 9 aa, Homo sapiens
FKFMKGHTL

SEQ ID NO: 3586 - protein, 9 aa, Homo sapiens
FKFMKGHTL

SEQ ID NO: 3587 - protein, 9 aa, Homo sapiens
SNMEKHSTI

SEQ ID NO: 3588 - protein, 9 aa, Homo sapiens
SNMEKHSTI

SEQ ID NO: 3589 - protein, 9 aa, Homo sapiens
KPSTISLPF

SEQ ID NO: 3590 - protein, 9 aa, Homo sapiens
RNMEKPSTI

SEQ ID NO: 3591 - protein, 9 aa, Homo sapiens
VRQGRLELA

SEQ ID NO: 3592 - protein, 9 aa, Homo sapiens
QPVIVSVPM

SEQ ID NO: 3593 - protein, 9 aa, Homo sapiens
VVQPMQLAF

SEQ ID NO: 3594 - protein, 9 aa, Homo sapiens
QPMQLAFQQ

SEQ ID NO: 3595 - protein, 9 aa, Homo sapiens
IIHTGEKPY

SEQ ID NO: 3596 - protein, 9 aa, Homo sapiens
IIHTGEKPY

SEQ ID NO: 3597 - protein, 9 aa, Homo sapiens
IIHTGEKPY

SEQ ID NO: 3598 - protein, 9 aa, Homo sapiens
KAFNRSSIL

SEQ ID NO: 3599 - protein, 9 aa, Homo sapiens
KAFNRSSIL

SEQ ID NO: 3600 - protein, 9 aa, Homo sapiens
KAFNRSSHL

SEQ ID NO: 3601 - protein, 9 aa, Homo sapiens
KAFNRSSHL

SEQ ID NO: 3602 - protein, 9 aa, Homo sapiens
IIHTGEKPY

SEQ ID NO: 3603 - protein, 9 aa, Homo sapiens
IIHTGEKPY

SEQ ID NO: 3604 - protein, 9 aa, Homo sapiens
SNLTKHKII

SEQ ID NO: 3605 - protein, 9 aa, Homo sapiens
IIHTGEKPY

SEQ ID NO: 3606 - protein, 9 aa, Homo sapiens
IIHTGEKPY

SEQ ID NO: 3607 - protein, 9 aa, Homo sapiens
IIHTGEKPY

SEQ ID NO: 3608 - protein, 9 aa, Homo sapiens
IIHTGEKPY

SEQ ID NO: 3609 - protein, 9 aa, Homo sapiens
IIHTGEKPY

SEQ ID NO: 3610 - protein, 9 aa, Homo sapiens
IIHTGEKPY

SEQ ID NO: 3611 - protein, 9 aa, Homo sapiens
IIHTGEKPY

SEQ ID NO: 3612 - protein, 9 aa, Homo sapiens
IIHTGEKPY

SEQ ID NO: 3613 - protein, 9 aa, Homo sapiens
IIHTGEKPY

SEQ ID NO: 3614 - protein, 9 aa, Homo sapiens
IIHTGEKPY

SEQ ID NO: 3615 - protein, 9 aa, Homo sapiens
KRKDNTIVV

SEQ ID NO: 3616 - protein, 9 aa, Homo sapiens
QHLQPGMVL

SEQ ID NO: 3617 - protein, 9 aa, Homo sapiens
VARHGPMCY

SEQ ID NO: 3618 - protein, 9 aa, Homo sapiens
ARHGPMCYL

SEQ ID NO: 3619 - protein, 9 aa, Homo sapiens
RHGPMCYLM

SEQ ID NO: 3620 - protein, 9 aa, Homo sapiens
QIHTGEKPY

SEQ ID NO: 3621 - protein, 9 aa, Homo sapiens
YYHSGEVLY

SEQ ID NO: 3622 - protein, 9 aa, Homo sapiens
FTYYHSGEV

SEQ ID NO: 3623 - protein, 9 aa, Homo sapiens
TYYHSGEVL

SEQ ID NO: 3624 - protein, 9 aa, Homo sapiens
YHSGEVLYL

SEQ ID NO: 3625 - protein, 9 aa, Homo sapiens
LHGPDHPRI

SEQ ID NO: 3626 - protein, 9 aa, Homo sapiens
LHGPDIPRI

SEQ ID NO: 3627 - protein, 9 aa, Homo sapiens
ETIRRFGHL

SEQ ID NO: 3628 - protein, 9 aa, Homo sapiens
RRFGHLDCV

SEQ ID NO: 3629 - protein, 9 aa, Homo sapiens
CQQSRRQLI

SEQ ID NO: 3630 - protein, 9 aa, Homo sapiens
MKGWRPRRL

SEQ ID NO: 3631 - protein, 9 aa, Homo sapiens
LPVLLSEIW

SEQ ID NO: 3632 - protein, 9 aa, Homo sapiens
DPRRRFLCG

SEQ ID NO: 3633 - protein, 9 aa, Homo sapiens
MLENYTNLL

SEQ ID NO: 3634 - protein, 9 aa, Homo sapiens
VLLQRSEVL

SEQ ID NO: 3635 - protein, 9 aa, Homo sapiens
FHAHYIAKC

SEQ ID NO: 3636 - protein, 9 aa, Homo sapiens
LTSVHGGTY

SEQ ID NO: 3637 - protein, 9 aa, Homo sapiens
FPMSPLTSV

SEQ ID NO: 3638 - protein, 9 aa, Homo sapiens
LTSVHGGTY

SEQ ID NO: 3639 - protein, 9 aa, Homo sapiens
NPLQEEASY

SEQ ID NO: 3640 - protein, 9 aa, Homo sapiens
TVHTVERPY

SEQ ID NO: 3641 - protein, 9 aa, Homo sapiens
EVVEDGYEF

SEQ ID NO: 3642 - protein, 9 aa, Homo sapiens
LHYDKLPGC

SEQ ID NO: 3643 - protein, 9 aa, Homo sapiens
EAAQGQQPH

SEQ ID NO: 3644 - protein, 9 aa, Homo sapiens
LPSGCSVPG

SEQ ID NO: 3645 - protein, 9 aa, Homo sapiens
QATAAVSAM

SEQ ID NO: 3646 - protein, 9 aa, Homo sapiens
LHTQATAAV

SEQ ID NO: 3647 - protein, 9 aa, Homo sapiens
TATAAVSAM

SEQ ID NO: 3648 - protein, 9 aa, Homo sapiens
FHHINRWRI

SEQ ID NO: 3649 - protein, 9 aa, Homo sapiens
LHWNRIRSI

SEQ ID NO: 3650 - protein, 9 aa, Homo sapiens
LPRRAGGAA

SEQ ID NO: 3651 - protein, 9 aa, Homo sapiens
IRDEFNAYY

SEQ ID NO: 3652 - protein, 9 aa, Homo sapiens
THSEKGPQA

SEQ ID NO: 3653 - protein, 9 aa, Homo sapiens
EGVEITITF

SEQ ID NO: 3654 - protein, 9 aa, Homo sapiens
LPLVLVPGL

SEQ ID NO: 3655 - protein, 9 aa, Homo sapiens
TSIPGLQPY

SEQ ID NO: 3656 - protein, 9 aa, Homo sapiens
QPYPGLDQM

SEQ ID NO: 3657 - protein, 9 aa, Homo sapiens
FRVGAENRF

SEQ ID NO: 3658 - protein, 9 aa, Homo sapiens
SRSSLKKFL

SEQ ID NO: 3659 - protein, 9 aa, Homo sapiens
LDDDTDVCY

SEQ ID NO: 3660 - protein, 9 aa, Homo sapiens
CPAGLPCSF

SEQ ID NO: 3661 - protein, 9 aa, Homo sapiens
LPCSFFAPV

SEQ ID NO: 3662 - protein, 9 aa, Homo sapiens
RFRNRTHSA

SEQ ID NO: 3663 - protein, 9 aa, Homo sapiens
RRREEEERL

SEQ ID NO: 3664 - protein, 9 aa, Homo sapiens
ERLKQEELL

SEQ ID NO: 3665 - protein, 9 aa, Homo sapiens
RPRSRVWAE

SEQ ID NO: 3666 - protein, 9 aa, Homo sapiens
WAWEVSDLH

SEQ ID NO: 3667 - protein, 9 aa, Homo sapiens
MRLCWAWEV

SEQ ID NO: 3668 - protein, 9 aa, Homo sapiens
LPTVAAASA

SEQ ID NO: 3669 - protein, 9 aa, Homo sapiens
VAAASAPVM

SEQ ID NO: 3670 - protein, 9 aa, Homo sapiens
KLDLKRQYY

SEQ ID NO: 3671 - protein, 9 aa, Homo sapiens
DLKRQYYRV

SEQ ID NO: 3672 - protein, 9 aa, Homo sapiens
YRVAQLDQL

SEQ ID NO: 3673 - protein, 9 aa, Homo sapiens
LPTADATAL

SEQ ID NO: 3674 - protein, 9 aa, Homo sapiens
TADATALTL

SEQ ID NO: 3675 - protein, 9 aa, Homo sapiens
TPNLFSTEF

SEQ ID NO: 3676 - protein, 9 aa, Homo sapiens
FSTEFSAEL

SEQ ID NO: 3677 - protein, 9 aa, Homo sapiens
SFLQGTTSY

SEQ ID NO: 3678 - protein, 9 aa, Homo sapiens
CQQEHIHQL

SEQ ID NO: 3679 - protein, 9 aa, Homo sapiens
EHIHQLQEL

SEQ ID NO: 3680 - protein, 9 aa, Homo sapiens
APSPLTEEM

SEQ ID NO: 3681 - protein, 9 aa, Homo sapiens
APLHSRDLY

SEQ ID NO: 3682 - protein, 9 aa, Homo sapiens
LHSRDLYSM

SEQ ID NO: 3683 - protein, 9 aa, Homo sapiens
SRDLYSMIV

SEQ ID NO: 3684 - protein, 9 aa, Homo sapiens
LTGKFASRY

SEQ ID NO: 3685 - protein, 9 aa, Homo sapiens
DTMSYHDSY

SEQ ID NO: 3686 - protein, 9 aa, Homo sapiens
DTMSYHDSY

SEQ ID NO: 3687 - protein, 9 aa, Homo sapiens
AARIVDTPF

SEQ ID NO: 3688 - protein, 9 aa, Homo sapiens
TRAHPEERL

SEQ ID NO: 3689 - protein, 9 aa, Homo sapiens
NIYMQRMCI

SEQ ID NO: 3690 - protein, 9 aa, Homo sapiens
LSSQRRRRL

SEQ ID NO: 3691 - protein, 9 aa, Homo sapiens
SQRRRRLAL

SEQ ID NO: 3692 - protein, 9 aa, Homo sapiens
QRRRRLALF

SEQ ID NO: 3693 - protein, 9 aa, Homo sapiens
LSSQRRRRL

SEQ ID NO: 3694 - protein, 9 aa, Homo sapiens
QRRRRLALF

SEQ ID NO: 3695 - protein, 9 aa, Homo sapiens
FPPALETAR

SEQ ID NO: 3696 - protein, 9 aa, Homo sapiens
FPYLRNNSA

SEQ ID NO: 3697 - protein, 9 aa, Homo sapiens
NSAYNAPSF

SEQ ID NO: 3698 - protein, 9 aa, Homo sapiens
SANTGPSHY

SEQ ID NO: 3699 - protein, 9 aa, Homo sapiens
SHYMTEGHL

SEQ ID NO: 3700 - protein, 9 aa, Homo sapiens
HPHSPWTPS

SEQ ID NO: 3701 - protein, 9 aa, Homo sapiens
PHSPWTPSL

SEQ ID NO: 3702 - protein, 9 aa, Homo sapiens
LDFQLSHSY

SEQ ID NO: 3703 - protein, 9 aa, Homo sapiens
FQLSHSYLV

SEQ ID NO: 3704 - protein, 9 aa, Homo sapiens
YPNCHVTRF

SEQ ID NO: 3705 - protein, 9 aa, Homo sapiens
YPNCHVTRF

SEQ ID NO: 3706 - protein, 9 aa, Homo sapiens
CRPSCSVSL

SEQ ID NO: 3707 - protein, 9 aa, Homo sapiens
IRQEHRQAL

SEQ ID NO: 3708 - protein, 9 aa, Homo sapiens
QHVSSPQGV

SEQ ID NO: 3709 - protein, 9 aa, Homo sapiens
LPYLSRRAM

SEQ ID NO: 3710 - protein, 9 aa, Homo sapiens
LPYLSRRAM

SEQ ID NO: 3711 - protein, 9 aa, Homo sapiens
RAMENSSLM

SEQ ID NO: 3712 - protein, 9 aa, Homo sapiens
RRAMENSSL

SEQ ID NO: 3713 - protein, 9 aa, Homo sapiens
RAMENSSLM

SEQ ID NO: 3714 - protein, 9 aa, Homo sapiens
HSHELNGPY

SEQ ID NO: 3715 - protein, 9 aa, Homo sapiens
HSHELNGPY

SEQ ID NO: 3716 - protein, 9 aa, Homo sapiens
DDMEDSTSF

SEQ ID NO: 3717 - protein, 9 aa, Homo sapiens
RRCNQTCEL

SEQ ID NO: 3718 - protein, 9 aa, Homo sapiens
MAPETDQFY

SEQ ID NO: 3719 - protein, 9 aa, Homo sapiens
FLMDQHMGF

SEQ ID NO: 3720 - protein, 9 aa, Homo sapiens
ERLDNGTWF

SEQ ID NO: 3721 - protein, 9 aa, Homo sapiens
FVYRLGCPF

SEQ ID NO: 3722 - protein, 9 aa, Homo sapiens
CWDTFVYRL

SEQ ID NO: 3723 - protein, 9 aa, Homo sapiens
PTLTFVCLY

SEQ ID NO: 3724 - protein, 9 aa, Homo sapiens
YNANWELEL

SEQ ID NO: 3725 - protein, 9 aa, Homo sapiens
SHNGSPLTY

SEQ ID NO: 3726 - protein, 9 aa, Homo sapiens
EPSPLPPPT

SEQ ID NO: 3727 - protein, 9 aa, Homo sapiens
DPQTKPTSM

SEQ ID NO: 3728 - protein, 9 aa, Homo sapiens
YLKSLFRSG

SEQ ID NO: 3729 - protein, 9 aa, Homo sapiens
RPILTVPEM

SEQ ID NO: 3730 - protein, 9 aa, Homo sapiens
FMSGSRVSM

SEQ ID NO: 3731 - protein, 9 aa, Homo sapiens
SYLDCIRSI

SEQ ID NO: 3732 - protein, 9 aa, Homo sapiens
WIDWLKQTY

SEQ ID NO: 3733 - protein, 9 aa, Homo sapiens
WIDWLKQTY

SEQ ID NO: 3734 - protein, 9 aa, Homo sapiens
RRFERQRKI

SEQ ID NO: 3735 - protein, 9 aa, Homo sapiens
LPVTDASSA

SEQ ID NO: 3736 - protein, 9 aa, Homo sapiens
LPVTSPSSA

SEQ ID NO: 3737 - protein, 9 aa, Homo sapiens
SPSSASSGH

SEQ ID NO: 3738 - protein, 9 aa, Homo sapiens
LSTGHTTPL

SEQ ID NO: 3739 - protein, 9 aa, Homo sapiens
LPVTSPSSA

SEQ ID NO: 3740 - protein, 9 aa, Homo sapiens
SPSSASTGH

SEQ ID NO: 3741 - protein, 9 aa, Homo sapiens
APVADVIAK

SEQ ID NO: 3742 - protein, 9 aa, Homo sapiens
IAKDLVLSM

SEQ ID NO: 3743 - protein, 9 aa, Homo sapiens
THTHTHSHV

SEQ ID NO: 3744 - protein, 9 aa, Homo sapiens
THSHTHTHV

SEQ ID NO: 3745 - protein, 9 aa, Homo sapiens
DLRQDFNIM

SEQ ID NO: 3746 - protein, 9 aa, Homo sapiens
LLADRHPSV

SEQ ID NO: 3747 - protein, 9 aa, Homo sapiens
CRNARAKGM

SEQ ID NO: 3748 - protein, 9 aa, Homo sapiens
ETDMFELLK

SEQ ID NO: 3749 - protein, 9 aa, Homo sapiens
FRRGLQEAF

SEQ ID NO: 3750 - protein, 9 aa, Homo sapiens
FAPFLSQTL

SEQ ID NO: 3751 - protein, 9 aa, Homo sapiens
RIHLYARAL

SEQ ID NO: 3752 - protein, 9 aa, Homo sapiens
TAAKRIHLY

SEQ ID NO: 3753 - protein, 9 aa, Homo sapiens
EMIATDREY

SEQ ID NO: 3754 - protein, 9 aa, Homo sapiens
TDREYIRCL

SEQ ID NO: 3755 - protein, 9 aa, Homo sapiens
ARSISIYEM

SEQ ID NO: 3756 - protein, 9 aa, Homo sapiens
YSILQVQPY

SEQ ID NO: 3757 - protein, 9 aa, Homo sapiens
YSILQVQPY

SEQ ID NO: 3758 - protein, 9 aa, Homo sapiens
GRLWHKSTV

SEQ ID NO: 3759 - protein, 9 aa, Homo sapiens
FRFDCGSVT

SEQ ID NO: 3760 - protein, 9 aa, Homo sapiens
DRSKRILPL

SEQ ID NO: 3761 - protein, 9 aa, Homo sapiens
DRSKRILPL

SEQ ID NO: 3762 - protein, 9 aa, Homo sapiens
PPAPAAPAF

SEQ ID NO: 3763 - protein, 9 aa, Homo sapiens
SPSAAAATA

SEQ ID NO: 3764 - protein, 9 aa, Homo sapiens
SAAAATAAA

SEQ ID NO: 3765 - protein, 9 aa, Homo sapiens
MCQVKKQPL

SEQ ID NO: 3766 - protein, 9 aa, Homo sapiens
TMMQKLIIL

SEQ ID NO: 3767 - protein, 9 aa, Homo sapiens
ERDTMMQKL

SEQ ID NO: 3768 - protein, 9 aa, Homo sapiens
ALAAKNVAL

SEQ ID NO: 3769 - protein, 9 aa, Homo sapiens
LPGPSASPF

SEQ ID NO: 3770 - protein, 9 aa, Homo sapiens
TRQEAEAAL

SEQ ID NO: 3771 - protein, 9 aa, Homo sapiens
DLYVDDVEM

SEQ ID NO: 3772 - protein, 9 aa, Homo sapiens
QITGSSCAF

SEQ ID NO: 3773 - protein, 9 aa, Homo sapiens
RLLSKVFSL

SEQ ID NO: 3774 - protein, 9 aa, Homo sapiens
VHSRLLSKV

SEQ ID NO: 3775 - protein, 9 aa, Homo sapiens
APRVKIYQL

SEQ ID NO: 3776 - protein, 9 aa, Homo sapiens
IPIKMVNFL

SEQ ID NO: 3777 - protein, 9 aa, Homo sapiens
RMAIKLKSF

SEQ ID NO: 3778 - protein, 9 aa, Homo sapiens
FPQKTIIPG

SEQ ID NO: 3779 - protein, 9 aa, Homo sapiens
IPGFKTTVY

SEQ ID NO: 3780 - protein, 9 aa, Homo sapiens
QHKPHIDKM

SEQ ID NO: 3781 - protein, 9 aa, Homo sapiens
FVAIKKYEL

SEQ ID NO: 3782 - protein, 9 aa, Homo sapiens
IPLKLEHAL

SEQ ID NO: 3783 - protein, 9 aa, Homo sapiens
LATENLQYI

SEQ ID NO: 3784 - protein, 9 aa, Homo sapiens
IKNNNLVYV

SEQ ID NO: 3785 - protein, 9 aa, Homo sapiens
CHSEEMWCI

SEQ ID NO: 3786 - protein, 9 aa, Homo sapiens
YPRQCQPCH

SEQ ID NO: 3787 - protein, 9 aa, Homo sapiens
VPMGPSGPL

SEQ ID NO: 3788 - protein, 9 aa, Homo sapiens
ALAPRRGSL

SEQ ID NO: 3789 - protein, 9 aa, Homo sapiens
LIMVHHWPE

SEQ ID NO: 3790 - protein, 9 aa, Homo sapiens
MVHHWPETV

SEQ ID NO: 3791 - protein, 9 aa, Homo sapiens
CHRGFCRLI

SEQ ID NO: 3792 - protein, 9 aa, Homo sapiens
EPNCIILGY

SEQ ID NO: 3793 - protein, 9 aa, Homo sapiens
LTSPFQLLA

SEQ ID NO: 3794 - protein, 9 aa, Homo sapiens
NAYALTSPF

SEQ ID NO: 3795 - protein, 9 aa, Homo sapiens
YALTSPFQL

SEQ ID NO: 3796 - protein, 9 aa, Homo sapiens
DVRPASTCF

SEQ ID NO: 3797 - protein, 9 aa, Homo sapiens
CSPKYPPLY

SEQ ID NO: 3798 - protein, 9 aa, Homo sapiens
SPLDCSPKY

SEQ ID NO: 3799 - protein, 9 aa, Homo sapiens
KRRQVKPLV

SEQ ID NO: 3800 - protein, 9 aa, Homo sapiens
ERLSYALSV

SEQ ID NO: 3801 - protein, 9 aa, Homo sapiens
RERQRNQSL

SEQ ID NO: 3802 - protein, 9 aa, Homo sapiens
RERQRNQSL

SEQ ID NO: 3803 - protein, 9 aa, Homo sapiens
HSFGKEGPF

SEQ ID NO: 3804 - protein, 9 aa, Homo sapiens
SRHRATDEL

SEQ ID NO: 3805 - protein, 9 aa, Homo sapiens
RHRATDELF

SEQ ID NO: 3806 - protein, 9 aa, Homo sapiens
VRSESDASL

SEQ ID NO: 3807 - protein, 9 aa, Homo sapiens
NHFNYEKTY

SEQ ID NO: 3808 - protein, 9 aa, Homo sapiens
NTSFRLRSL

SEQ ID NO: 3809 - protein, 9 aa, Homo sapiens
SKRELSREI

SEQ ID NO: 3810 - protein, 9 aa, Homo sapiens
IAGNFDVAF

SEQ ID NO: 3811 - protein, 9 aa, Homo sapiens
IPACTELET

SEQ ID NO: 3812 - protein, 9 aa, Homo sapiens
SALTKHKRI

SEQ ID NO: 3813 - protein, 9 aa, Homo sapiens
RIHTGDRPY

SEQ ID NO: 3814 - protein, 9 aa, Homo sapiens
HTGDRPTSV

SEQ ID NO: 3815 - protein, 9 aa, Homo sapiens
IIHTGENSY

SEQ ID NO: 3816 - protein, 9 aa, Homo sapiens
HTGEKPYKY

SEQ ID NO: 3817 - protein, 9 aa, Homo sapiens
IIHTGEKPY

SEQ ID NO: 3818 - protein, 9 aa, Homo sapiens
IPFKRPFTY

SEQ ID NO: 3819 - protein, 9 aa, Homo sapiens
QVVDGSISL

SEQ ID NO: 3820 - protein, 9 aa, Homo sapiens
MVNGKPNKV

SEQ ID NO: 3821 - protein, 9 aa, Homo sapiens
VVTEDTFSF

SEQ ID NO: 3822 - protein, 9 aa, Homo sapiens
DRSKMSPYV

SEQ ID NO: 3823 - protein, 9 aa, Homo sapiens
FHRGGVVRL

SEQ ID NO: 3824 - protein, 9 aa, Homo sapiens
HRGGVVRLL

SEQ ID NO: 3825 - protein, 9 aa, Homo sapiens
RRFQLYHSM

SEQ ID NO: 3826 - protein, 9 aa, Homo sapiens
RRFQLDRSM

SEQ ID NO: 3827 - protein, 9 aa, Homo sapiens
LLRKRWFQL

SEQ ID NO: 3828 - protein, 9 aa, Homo sapiens
ALRARRKEI

SEQ ID NO: 3829 - protein, 9 aa, Homo sapiens
LRARRKEIF

SEQ ID NO: 3830 - protein, 9 aa, Homo sapiens
YREDRTSLP

SEQ ID NO: 3831 - protein, 9 aa, Homo sapiens
SRSPRNLIY

SEQ ID NO: 3832 - protein, 9 aa, Homo sapiens
SARATGTAL

SEQ ID NO: 3833 - protein, 9 aa, Homo sapiens
LRRSPRNLI

SEQ ID NO: 3834 - protein, 9 aa, Homo sapiens
LAEGSLHDY

SEQ ID NO: 3835 - protein, 9 aa, Homo sapiens
LAEGSLHDY

SEQ ID NO: 3836 - protein, 9 aa, Homo sapiens
FNREWASVM

SEQ ID NO: 3837 - protein, 9 aa, Homo sapiens
YSFNPGYAM

SEQ ID NO: 3838 - protein, 9 aa, Homo sapiens
GPIWLYEVF

SEQ ID NO: 3839 - protein, 9 aa, Homo sapiens
SSISSILPF

SEQ ID NO: 3840 - protein, 9 aa, Homo sapiens
TYHDQLVKL

SEQ ID NO: 3841 - protein, 9 aa, Homo sapiens
YHDQLVKLL

SEQ ID NO: 3842 - protein, 9 aa, Homo sapiens
HKRRKRMHL

SEQ ID NO: 3843 - protein, 9 aa, Homo sapiens
RRKRMHLEL

SEQ ID NO: 3844 - protein, 9 aa, Homo sapiens
PHHKRRKRM

SEQ ID NO: 3845 - protein, 9 aa, Homo sapiens
RRKRMHLEL

SEQ ID NO: 3846 - protein, 9 aa, Homo sapiens
LALNLSVFY

SEQ ID NO: 3847 - protein, 9 aa, Homo sapiens
IRLGLALNL

SEQ ID NO: 3848 - protein, 9 aa, Homo sapiens
VSAVGVPPM

SEQ ID NO: 3849 - protein, 9 aa, Homo sapiens
FTYGNVVFY

SEQ ID NO: 3850 - protein, 9 aa, Homo sapiens
FTYGNVVFY

SEQ ID NO: 3851 - protein, 9 aa, Homo sapiens
FTYGNVVFY

SEQ ID NO: 3852 - protein, 9 aa, Homo sapiens
HPLPSCEAL

SEQ ID NO: 3853 - protein, 9 aa, Homo sapiens
LPSCEALCG

SEQ ID NO: 3854 - protein, 9 aa, Homo sapiens
LVASPQDGY

SEQ ID NO: 3855 - protein, 9 aa, Homo sapiens
SPQDGYVPF

SEQ ID NO: 3856 - protein, 9 aa, Homo sapiens
TLHSRVFQI

SEQ ID NO: 3857 - protein, 9 aa, Homo sapiens
LHSRVFQIL

SEQ ID NO: 3858 - protein, 9 aa, Homo sapiens
EPENAVTIM

SEQ ID NO: 3859 - protein, 9 aa, Homo sapiens
MPLRPEDDY

SEQ ID NO: 3860 - protein, 9 aa, Homo sapiens
MPREDAHFM

SEQ ID NO: 3861 - protein, 9 aa, Homo sapiens
IATLGIVVM

SEQ ID NO: 3862 - protein, 9 aa, Homo sapiens
GHRDVARCL

SEQ ID NO: 3863 - protein, 9 aa, Homo sapiens
QPYSPSAQL

SEQ ID NO: 3864 - protein, 9 aa, Homo sapiens
YFNGHVWPM

SEQ ID NO: 3865 - protein, 9 aa, Homo sapiens
CPRQQLKTL

SEQ ID NO: 3866 - protein, 9 aa, Homo sapiens
VPLAHWVCL

SEQ ID NO: 3867 - protein, 9 aa, Homo sapiens
VPLAHWVCL

SEQ ID NO: 3868 - protein, 9 aa, Homo sapiens
KTDCAELAV

SEQ ID NO: 3869 - protein, 9 aa, Homo sapiens
LYYQINATY

SEQ ID NO: 3870 - protein, 9 aa, Homo sapiens
YPWVRDLCG

SEQ ID NO: 3871 - protein, 9 aa, Homo sapiens
ATYPWVRDL

SEQ ID NO: 3872 - protein, 9 aa, Homo sapiens
SLKYLDLSL

SEQ ID NO: 3873 - protein, 9 aa, Homo sapiens
LSLNGVITM

SEQ ID NO: 3874 - protein, 9 aa, Homo sapiens
WRRLRKAPL

SEQ ID NO: 3875 - protein, 9 aa, Homo sapiens
IANVEPVPF

SEQ ID NO: 3876 - protein, 9 aa, Homo sapiens
EPVPFDAAT

SEQ ID NO: 3877 - protein, 9 aa, Homo sapiens
SHIANVEPV

SEQ ID NO: 3878 - protein, 9 aa, Homo sapiens
YPAHFIHAD

SEQ ID NO: 3879 - protein, 9 aa, Homo sapiens
KMREKGMKL

SEQ ID NO: 3880 - protein, 9 aa, Homo sapiens
MREKGMKLL

SEQ ID NO: 3881 - protein, 9 aa, Homo sapiens
TRSHRARGV

SEQ ID NO: 3882 - protein, 9 aa, Homo sapiens
HRARGVPHL

SEQ ID NO: 3883 - protein, 9 aa, Homo sapiens
FLDSHGAWL

SEQ ID NO: 3884 - protein, 9 aa, Homo sapiens
SHGAWLPEL

SEQ ID NO: 3885 - protein, 9 aa, Homo sapiens
VRIPKEQGL

SEQ ID NO: 3886 - protein, 9 aa, Homo sapiens
RASSHGTEL

SEQ ID NO: 3887 - protein, 9 aa, Homo sapiens
FLHLCWTVY

SEQ ID NO: 3888 - protein, 9 aa, Homo sapiens
APGALSSQY

SEQ ID NO: 3889 - protein, 9 aa, Homo sapiens
EPHPYVPVL

SEQ ID NO: 3890 - protein, 9 aa, Homo sapiens
WLYLRTQST

SEQ ID NO: 3891 - protein, 9 aa, Homo sapiens
LTDWLSLLN

SEQ ID NO: 3892 - protein, 9 aa, Homo sapiens
KAVLQSPEF

SEQ ID NO: 3893 - protein, 9 aa, Homo sapiens
PPKTRASHL

SEQ ID NO: 3894 - protein, 9 aa, Homo sapiens
SAFSRAWVI

SEQ ID NO: 3895 - protein, 9 aa, Homo sapiens
SAFSRAWVI

SEQ ID NO: 3896 - protein, 9 aa, Homo sapiens
THTREKPFV

SEQ ID NO: 3897 - protein, 9 aa, Homo sapiens
DRAEARTRM

SEQ ID NO: 3898 - protein, 9 aa, Homo sapiens
MAAACWSVK

SEQ ID NO: 3899 - protein, 9 aa, Homo sapiens
VPSEPHFVH

SEQ ID NO: 3900 - protein, 9 aa, Homo sapiens
CRITMNPKV

SEQ ID NO: 3901 - protein, 9 aa, Homo sapiens
HLMTPSSSY

SEQ ID NO: 3902 - protein, 9 aa, Homo sapiens
FIKDYMKSI

SEQ ID NO: 3903 - protein, 9 aa, Homo sapiens
TMVCRLYSA

SEQ ID NO: 3904 - protein, 9 aa, Homo sapiens
LMNNLESFY

SEQ ID NO: 3905 - protein, 9 aa, Homo sapiens
FPVGRPPRA

SEQ ID NO: 3906 - protein, 9 aa, Homo sapiens
EAANFDLPV

SEQ ID NO: 3907 - protein, 9 aa, Homo sapiens
WIKMYSDAF

SEQ ID NO: 3908 - protein, 9 aa, Homo sapiens
WIKMYSDAF

SEQ ID NO: 3909 - protein, 9 aa, Homo sapiens
DRHGHKDCI

SEQ ID NO: 3910 - protein, 9 aa, Homo sapiens
GHKDCIFAV

SEQ ID NO: 3911 - protein, 9 aa, Homo sapiens
GSRKRKPPA

SEQ ID NO: 3912 - protein, 9 aa, Homo sapiens
SRKRKPPAV

SEQ ID NO: 3913 - protein, 9 aa, Homo sapiens
SRKRKPPAV

SEQ ID NO: 3914 - protein, 9 aa, Homo sapiens
FPEDGTSQV

SEQ ID NO: 3915 - protein, 9 aa, Homo sapiens
SGFHENTTY

SEQ ID NO: 3916 - protein, 9 aa, Homo sapiens
SPKTMKKFI

SEQ ID NO: 3917 - protein, 9 aa, Homo sapiens
SRVPGHSSI

SEQ ID NO: 3918 - protein, 9 aa, Homo sapiens
SPLQFYLDY

SEQ ID NO: 3919 - protein, 9 aa, Homo sapiens
LFCKKSSPL

SEQ ID NO: 3920 - protein, 9 aa, Homo sapiens
ELRRQMKTL

SEQ ID NO: 3921 - protein, 9 aa, Homo sapiens
RLMDKDCVL

SEQ ID NO: 3922 - protein, 9 aa, Homo sapiens
SNLMRDRSA

SEQ ID NO: 3923 - protein, 9 aa, Homo sapiens
NLMRDRSAA

SEQ ID NO: 3924 - protein, 9 aa, Homo sapiens
NLRSLENSL

SEQ ID NO: 3925 - protein, 9 aa, Homo sapiens
FLWTKDMAA

SEQ ID NO: 3926 - protein, 9 aa, Homo sapiens
HIILHYYAF

SEQ ID NO: 3927 - protein, 9 aa, Homo sapiens
HIILHYYAF

SEQ ID NO: 3928 - protein, 9 aa, Homo sapiens
HYYAFKTTW

SEQ ID NO: 3929 - protein, 9 aa, Homo sapiens
IHPDGEKVV

SEQ ID NO: 3930 - protein, 9 aa, Homo sapiens
MREEYDALL

SEQ ID NO: 3931 - protein, 9 aa, Homo sapiens
AKFQNQVEM

SEQ ID NO: 3932 - protein, 9 aa, Homo sapiens
TSDMWLHRA

SEQ ID NO: 3933 - protein, 9 aa, Homo sapiens
LHRAYSGNL

SEQ ID NO: 3934 - protein, 9 aa, Homo sapiens
EDITRRKAL

SEQ ID NO: 3935 - protein, 9 aa, Homo sapiens
RWMKHERGL

SEQ ID NO: 3936 - protein, 9 aa, Homo sapiens
IREQHCLFL

SEQ ID NO: 3937 - protein, 9 aa, Homo sapiens
KFYDCGKSF

SEQ ID NO: 3938 - protein, 9 aa, Homo sapiens
SESNRGPSL

SEQ ID NO: 3939 - protein, 9 aa, Homo sapiens
WRHIYDTKL

SEQ ID NO: 3940 - protein, 9 aa, Homo sapiens
WRHIYDTKL

SEQ ID NO: 3941 - protein, 9 aa, Homo sapiens
KRGENSVSV

SEQ ID NO: 3942 - protein, 9 aa, Homo sapiens
RRYGEQKTL

SEQ ID NO: 3943 - protein, 9 aa, Homo sapiens
RRYGEQKTL

SEQ ID NO: 3944 - protein, 9 aa, Homo sapiens
RYGEQKTLF

SEQ ID NO: 3945 - protein, 9 aa, Homo sapiens
SAKMRRYDQ

SEQ ID NO: 3946 - protein, 9 aa, Homo sapiens
KMRRYDQGL

SEQ ID NO: 3947 - protein, 9 aa, Homo sapiens
RRYDQGLKT

SEQ ID NO: 3948 - protein, 9 aa, Homo sapiens
KAFKCPSTL

SEQ ID NO: 3949 - protein, 9 aa, Homo sapiens
KAFKYSSSL

SEQ ID NO: 3950 - protein, 9 aa, Homo sapiens
KAFKYSSSL

SEQ ID NO: 3951 - protein, 9 aa, Homo sapiens
KAFNQSSTL

SEQ ID NO: 3952 - protein, 9 aa, Homo sapiens
SHLTTHIMI

SEQ ID NO: 3953 - protein, 9 aa, Homo sapiens
TRHKRIHTG

SEQ ID NO: 3954 - protein, 9 aa, Homo sapiens
SHLAQHKRI

SEQ ID NO: 3955 - protein, 9 aa, Homo sapiens
TLEPNSLPF

SEQ ID NO: 3956 - protein, 9 aa, Homo sapiens
FASPAGLEL

SEQ ID NO: 3957 - protein, 9 aa, Homo sapiens
SPAGLELGL

SEQ ID NO: 3958 - protein, 9 aa, Homo sapiens
FASPAGLEL

SEQ ID NO: 3959 - protein, 9 aa, Homo sapiens
YVMTQEQHV

SEQ ID NO: 3960 - protein, 9 aa, Homo sapiens
YRCNECSKV

SEQ ID NO: 3961 - protein, 9 aa, Homo sapiens
RLCHHVLSL

SEQ ID NO: 3962 - protein, 9 aa, Homo sapiens
CHHVLSLAL

SEQ ID NO: 3963 - protein, 9 aa, Homo sapiens
LFRYKLQDF

SEQ ID NO: 3964 - protein, 9 aa, Homo sapiens
IISDYHQLF

SEQ ID NO: 3965 - protein, 9 aa, Homo sapiens
YHQLFRYKL

SEQ ID NO: 3966 - protein, 9 aa, Homo sapiens
YHQLFRYKL

SEQ ID NO: 3967 - protein, 9 aa, Homo sapiens
VLFTRHKPL

SEQ ID NO: 3968 - protein, 9 aa, Homo sapiens
VLFTRHKPL

SEQ ID NO: 3969 - protein, 9 aa, Homo sapiens
RPSPPPPAS

SEQ ID NO: 3970 - protein, 9 aa, Homo sapiens
AATAQPSPL

SEQ ID NO: 3971 - protein, 9 aa, Homo sapiens
RARRFLACL

SEQ ID NO: 3972 - protein, 9 aa, Homo sapiens
QRARRFLAC

SEQ ID NO: 3973 - protein, 9 aa, Homo sapiens
RARRFLACL

SEQ ID NO: 3974 - protein, 9 aa, Homo sapiens
SPWTPSLLT

SEQ ID NO: 3975 - protein, 9 aa, Homo sapiens
SPWTPSLTL

SEQ ID NO: 3976 - protein, 9 aa, Homo sapiens
HSSPWTPSL

SEQ ID NO: 3977 - protein, 9 aa, Homo sapiens
HPHSSPWTL

SEQ ID NO: 3978 - protein, 9 aa, Homo sapiens
WPGNAWRTA

SEQ ID NO: 3979 - protein, 9 aa, Homo sapiens
WPMQQARAQ

SEQ ID NO: 3980 - protein, 9 aa, Homo sapiens
NIWSQVWPM

SEQ ID NO: 3981 - protein, 9 aa, Homo sapiens
EISLRLHCL

SEQ ID NO: 3982 - protein, 9 aa, Homo sapiens
SPETEIVPL

SEQ ID NO: 3983 - protein, 9 aa, Homo sapiens
KPEPGEPLL

SEQ ID NO: 3984 - protein, 9 aa, Homo sapiens
NTAAALGVY

SEQ ID NO: 3985 - protein, 9 aa, Homo sapiens
EALVRMLVL

SEQ ID NO: 3986 - protein, 9 aa, Homo sapiens
PPAAPLSKL

SEQ ID NO: 3987 - protein, 9 aa, Homo sapiens
HTGERPYPY

SEQ ID NO: 3988 - protein, 9 aa, Homo sapiens
STLTRHKII

SEQ ID NO: 3989 - protein, 9 aa, Homo sapiens
APASKSLTL

SEQ ID NO: 3990 - protein, 9 aa, Homo sapiens
APASKSLTL

SEQ ID NO: 3991 - protein, 9 aa, Homo sapiens
QRAPASKSL

SEQ ID NO: 3992 - protein, 9 aa, Homo sapiens
GPRPTREAS

SEQ ID NO: 3993 - protein, 9 aa, Homo sapiens
EVIDRLRYF

SEQ ID NO: 3994 - protein, 9 aa, Homo sapiens
YFKAEIEDL

SEQ ID NO: 3995 - protein, 9 aa, Homo sapiens
HFLPPTLPT

SEQ ID NO: 3996 - protein, 9 aa, Homo sapiens
RRRDCVHLR

SEQ ID NO: 3997 - protein, 9 aa, Homo sapiens
QPSKRRMQA

SEQ ID NO: 3998 - protein, 9 aa, Homo sapiens
QPSKRRMQA

SEQ ID NO: 3999 - protein, 9 aa, Homo sapiens
SQLQRLKEL

SEQ ID NO: 4000 - protein, 9 aa, Homo sapiens
KAKKLPANI

SEQ ID NO: 4001 - protein, 9 aa, Homo sapiens
DTHYWAVWY

SEQ ID NO: 4002 - protein, 9 aa, Homo sapiens
WAVWYGPRV

SEQ ID NO: 4003 - protein, 9 aa, Homo sapiens
ILVSCIRII

SEQ ID NO: 4004 - protein, 9 aa, Homo sapiens
PMYLFLSFI

SEQ ID NO: 4005 - protein, 9 aa, Homo sapiens
YLFLSFISF

SEQ ID NO: 4006 - protein, 9 aa, Homo sapiens
HLFPPKVDL

SEQ ID NO: 4007 - protein, 9 aa, Homo sapiens
APYCADGKV

SEQ ID NO: 4008 - protein, 9 aa, Homo sapiens
FPDWEWTKL

SEQ ID NO: 4009 - protein, 9 aa, Homo sapiens
FPDWEWTKL

SEQ ID NO: 4010 - protein, 9 aa, Homo sapiens
TYPEGNQAI

SEQ ID NO: 4011 - protein, 9 aa, Homo sapiens
YPEGNQAIY

SEQ ID NO: 4012 - protein, 9 aa, Homo sapiens
VQPTALLLF

SEQ ID NO: 4013 - protein, 9 aa, Homo sapiens
QRSFHNFSL

SEQ ID NO: 4014 - protein, 9 aa, Homo sapiens
FHNFSLCYI

SEQ ID NO: 4015 - protein, 9 aa, Homo sapiens
RYQRELKKL

SEQ ID NO: 4016 - protein, 9 aa, Homo sapiens
LFHNDIHHV

SEQ ID NO: 4017 - protein, 9 aa, Homo sapiens
YTVVAFNFL

SEQ ID NO: 4018 - protein, 9 aa, Homo sapiens
VAFNFLRKF

SEQ ID NO: 4019 - protein, 9 aa, Homo sapiens
FVQTAMDYF

SEQ ID NO: 4020 - protein, 9 aa, Homo sapiens
TAMDYFPKI

SEQ ID NO: 4021 - protein, 9 aa, Homo sapiens
CASNIIHLF

SEQ ID NO: 4022 - protein, 9 aa, Homo sapiens
FCASNIIHL

SEQ ID NO: 4023 - protein, 9 aa, Homo sapiens
VFYTILTTM

SEQ ID NO: 4024 - protein, 9 aa, Homo sapiens
KVVSGFYTI

SEQ ID NO: 4025 - protein, 9 aa, Homo sapiens
KVVSGFYTI

SEQ ID NO: 4026 - protein, 9 aa, Homo sapiens
VVSGFYTIV

SEQ ID NO: 4027 - protein, 9 aa, Homo sapiens
MAAMFVGSF

SEQ ID NO: 4028 - protein, 9 aa, Homo sapiens
MAAMFVGSF

SEQ ID NO: 4029 - protein, 9 aa, Homo sapiens
AAMFVGSFV

SEQ ID NO: 4030 - protein, 9 aa, Homo sapiens
LYLAKQVFF

SEQ ID NO: 4031 - protein, 9 aa, Homo sapiens
QVFFGFLLI

SEQ ID NO: 4032 - protein, 9 aa, Homo sapiens
ATREFGVKI

SEQ ID NO: 4033 - protein, 9 aa, Homo sapiens
FGVKIAKAV

SEQ ID NO: 4034 - protein, 9 aa, Homo sapiens
IMDDLTKVL

SEQ ID NO: 4035 - protein, 9 aa, Homo sapiens
LFPPFVNPF

SEQ ID NO: 4036 - protein, 9 aa, Homo sapiens
FPPFVNPFI

SEQ ID NO: 4037 - protein, 9 aa, Homo sapiens
FVNPFIYSI

SEQ ID NO: 4038 - protein, 9 aa, Homo sapiens
VATTGDITL

SEQ ID NO: 4039 - protein, 9 aa, Homo sapiens
TTGDITLSV

SEQ ID NO: 4040 - protein, 9 aa, Homo sapiens
LIATGMFLF

SEQ ID NO: 4041 - protein, 9 aa, Homo sapiens
MFLFWPHSI

SEQ ID NO: 4042 - protein, 9 aa, Homo sapiens
MFLFWPHSI

SEQ ID NO: 4043 - protein, 9 aa, Homo sapiens
IYTIANCSF

SEQ ID NO: 4044 - protein, 9 aa, Homo sapiens
KPLHYMTII

SEQ ID NO: 4045 - protein, 9 aa, Homo sapiens
FHPHGVQAV

SEQ ID NO: 4046 - protein, 9 aa, Homo sapiens
QAVGAFANL

SEQ ID NO: 4047 - protein, 9 aa, Homo sapiens
DYVDLPEYF

SEQ ID NO: 4048 - protein, 9 aa, Homo sapiens
SPYKQSEIL

SEQ ID NO: 4049 - protein, 9 aa, Homo sapiens
LVVDLKNKY

SEQ ID NO: 4050 - protein, 9 aa, Homo sapiens
RYVNLNSLL

SEQ ID NO: 4051 - protein, 9 aa, Homo sapiens
MRYVNLNSL

SEQ ID NO: 4052 - protein, 9 aa, Homo sapiens
YVNLNSLLI

SEQ ID NO: 4053 - protein, 9 aa, Homo sapiens
EYVPSASLF

SEQ ID NO: 4054 - protein, 9 aa, Homo sapiens
LAGQPLEYV

SEQ ID NO: 4055 - protein, 9 aa, Homo sapiens
LEYVPSASL

SEQ ID NO: 4056 - protein, 9 aa, Homo sapiens
DHMISDVFL

SEQ ID NO: 4057 - protein, 9 aa, Homo sapiens
MISDVFLTI

SEQ ID NO: 4058 - protein, 9 aa, Homo sapiens
KQFESLKQL

SEQ ID NO: 4059 - protein, 9 aa, Homo sapiens
LMGKGMKMV

SEQ ID NO: 4060 - protein, 9 aa, Homo sapiens
TYNPVWQIR

SEQ ID NO: 4061 - protein, 9 aa, Homo sapiens
DTYNPVWQI

SEQ ID NO: 4062 - protein, 9 aa, Homo sapiens
LLYMKEKPI

SEQ ID NO: 4063 - protein, 9 aa, Homo sapiens
YMKEKPITY

SEQ ID NO: 4064 - protein, 9 aa, Homo sapiens
ITYEHGVKL

SEQ ID NO: 4065 - protein, 9 aa, Homo sapiens
VAFPAAAPV

SEQ ID NO: 4066 - protein, 9 aa, Homo sapiens
NPMHRLLNL

SEQ ID NO: 4067 - protein, 9 aa, Homo sapiens
EVMAPDVVV

SEQ ID NO: 4068 - protein, 9 aa, Homo sapiens
MAPDVVVSL

SEQ ID NO: 4069 - protein, 9 aa, Homo sapiens
MAPDVQVSL

SEQ ID NO: 4070 - protein, 9 aa, Homo sapiens
VALDFENEI

SEQ ID NO: 4071 - protein, 9 aa, Homo sapiens
KNLPPVLIV

SEQ ID NO: 4072 - protein, 9 aa, Homo sapiens
VLLADILPI

SEQ ID NO: 4073 - protein, 9 aa, Homo sapiens
LADILPILV

SEQ ID NO: 4074 - protein, 9 aa, Homo sapiens
MAGSGRLAL

SEQ ID NO: 4075 - protein, 9 aa, Homo sapiens
IYQFLHSRF

SEQ ID NO: 4076 - protein, 9 aa, Homo sapiens
FLHSRFPFF

SEQ ID NO: 4077 - protein, 9 aa, Homo sapiens
TLKDAVITV

SEQ ID NO: 4078 - protein, 9 aa, Homo sapiens
MMVPIAHAI

SEQ ID NO: 4079 - protein, 9 aa, Homo sapiens
IAHAILDQL

SEQ ID NO: 4080 - protein, 9 aa, Homo sapiens
VAVLQLHEV

SEQ ID NO: 4081 - protein, 9 aa, Homo sapiens
LQLHEVNLY

SEQ ID NO: 4082 - protein, 9 aa, Homo sapiens
FQNNEVALL

SEQ ID NO: 4083 - protein, 9 aa, Homo sapiens
NLVNVINGY

SEQ ID NO: 4084 - protein, 9 aa, Homo sapiens
VLDNLVNVI

SEQ ID NO: 4085 - protein, 9 aa, Homo sapiens
YQRQRHSEI

SEQ ID NO: 4086 - protein, 9 aa, Homo sapiens
YQRQRTSEI

SEQ ID NO: 4087 - protein, 9 aa, Homo sapiens
SFYGLMPTF

SEQ ID NO: 4088 - protein, 9 aa, Homo sapiens
MMYGDNSFY

SEQ ID NO: 4089 - protein, 9 aa, Homo sapiens
FPDGPMREY

SEQ ID NO: 4090 - protein, 9 aa, Homo sapiens
TAHQTSAQI

SEQ ID NO: 4091 - protein, 9 aa, Homo sapiens
TSAQIPNLV

SEQ ID NO: 4092 - protein, 9 aa, Homo sapiens
IFLCSFLQL

SEQ ID NO: 4093 - protein, 9 aa, Homo sapiens
LQLNLFVAV

SEQ ID NO: 4094 - protein, 9 aa, Homo sapiens
QLNLFVAVI

SEQ ID NO: 4095 - protein, 9 aa, Homo sapiens
KSFCMLSKL

SEQ ID NO: 4096 - protein, 9 aa, Homo sapiens
KAFIQSSTL

SEQ ID NO: 4097 - protein, 9 aa, Homo sapiens
YSETLKPSI

SEQ ID NO: 4098 - protein, 9 aa, Homo sapiens
ETCASILLY

SEQ ID NO: 4099 - protein, 9 aa, Homo sapiens
YNKETCASI

SEQ ID NO: 4100 - protein, 9 aa, Homo sapiens
LLLGPAAFI

SEQ ID NO: 4101 - protein, 9 aa, Homo sapiens
KSFHRNSSL

SEQ ID NO: 4102 - protein, 9 aa, Homo sapiens
RAIPNTRHL

SEQ ID NO: 4103 - protein, 9 aa, Homo sapiens
NTRHLRCTL

SEQ ID NO: 4104 - protein, 9 aa, Homo sapiens
ASFDATACI

SEQ ID NO: 4105 - protein, 9 aa, Homo sapiens
FVFSFNAPL

SEQ ID NO: 4106 - protein, 9 aa, Homo sapiens
ETFNTLAMY

SEQ ID NO: 4107 - protein, 9 aa, Homo sapiens
IMFETFNTL

SEQ ID NO: 4108 - protein, 9 aa, Homo sapiens
ETFNTLAMY

SEQ ID NO: 4109 - protein, 9 aa, Homo sapiens
NTLAMYVAI

SEQ ID NO: 4110 - protein, 9 aa, Homo sapiens
YYNRLMNGL

SEQ ID NO: 4111 - protein, 9 aa, Homo sapiens
MAHQKPTHA

SEQ ID NO: 4112 - protein, 9 aa, Homo sapiens
HALEKVVPL

SEQ ID NO: 4113 - protein, 9 aa, Homo sapiens
ETFGNSMIF

SEQ ID NO: 4114 - protein, 9 aa, Homo sapiens
FLFQITTSA

SEQ ID NO: 4115 - protein, 9 aa, Homo sapiens
RMKDKPQRL

SEQ ID NO: 4116 - protein, 9 aa, Homo sapiens
QARHTGINI

SEQ ID NO: 4117 - protein, 9 aa, Homo sapiens
HAFSPRDIT

SEQ ID NO: 4118 - protein, 9 aa, Homo sapiens
FVTNGPGNY

SEQ ID NO: 4119 - protein, 9 aa, Homo sapiens
TYIDSSSMF

SEQ ID NO: 4120 - protein, 9 aa, Homo sapiens
NTYIDSSSM

SEQ ID NO: 4121 - protein, 9 aa, Homo sapiens
ETALIVETM

SEQ ID NO: 4122 - protein, 9 aa, Homo sapiens
QTYEETALI

SEQ ID NO: 4123 - protein, 9 aa, Homo sapiens
TALIVETMI

SEQ ID NO: 4124 - protein, 9 aa, Homo sapiens
NTAKNKRFV

SEQ ID NO: 4125 - protein, 9 aa, Homo sapiens
HTVQHLQEV

SEQ ID NO: 4126 - protein, 9 aa, Homo sapiens
HTVQHLQEV

SEQ ID NO: 4127 - protein, 9 aa, Homo sapiens
QSDVHTEAV

SEQ ID NO: 4128 - protein, 9 aa, Homo sapiens
VTQRPISPL

SEQ ID NO: 4129 - protein, 9 aa, Homo sapiens
QHSTIVMTL

SEQ ID NO: 4130 - protein, 9 aa, Homo sapiens
YSQHSTIVM

SEQ ID NO: 4131 - protein, 9 aa, Homo sapiens
YQVVPEGHL

SEQ ID NO: 4132 - protein, 9 aa, Homo sapiens
HPKEYVTLL

SEQ ID NO: 4133 - protein, 9 aa, Homo sapiens
KYCAVCYII

SEQ ID NO: 4134 - protein, 9 aa, Homo sapiens
CYIIQIHFV

SEQ ID NO: 4135 - protein, 9 aa, Homo sapiens
WKYCAVCYI

SEQ ID NO: 4136 - protein, 9 aa, Homo sapiens
CAVCYIIQI

SEQ ID NO: 4137 - protein, 9 aa, Homo sapiens
RSFLVYASF

SEQ ID NO: 4138 - protein, 9 aa, Homo sapiens
FVIYGDSLL

SEQ ID NO: 4139 - protein, 9 aa, Homo sapiens
FVIYGDSLL

SEQ ID NO: 4140 - protein, 9 aa, Homo sapiens
VIYGDSLLV

SEQ ID NO: 4141 - protein, 9 aa, Homo sapiens
FLFRKLASV

SEQ ID NO: 4142 - protein, 9 aa, Homo sapiens
LASVFGEDV

SEQ ID NO: 4143 - protein, 9 aa, Homo sapiens
CACERDRRV

SEQ ID NO: 4144 - protein, 9 aa, Homo sapiens
LAHGKRWIL

SEQ ID NO: 4145 - protein, 9 aa, Homo sapiens
WIGGAIPTV

SEQ ID NO: 4146 - protein, 9 aa, Homo sapiens
QPAAGGERI

SEQ ID NO: 4147 - protein, 9 aa, Homo sapiens
ENADKGTTV

SEQ ID NO: 4148 - protein, 9 aa, Homo sapiens
NADKGTTVI

SEQ ID NO: 4149 - protein, 9 aa, Homo sapiens
WAGSAGGTV

SEQ ID NO: 4150 - protein, 9 aa, Homo sapiens
LSSTVTLTV

SEQ ID NO: 4151 - protein, 9 aa, Homo sapiens
RSPPFNVQI

SEQ ID NO: 4152 - protein, 9 aa, Homo sapiens
LQFRPDLLL

SEQ ID NO: 4153 - protein, 9 aa, Homo sapiens
FVHNNSKHV

SEQ ID NO: 4154 - protein, 9 aa, Homo sapiens
TANKDGTHV

SEQ ID NO: 4155 - protein, 9 aa, Homo sapiens
RVGPVSAIV

SEQ ID NO: 4156 - protein, 9 aa, Homo sapiens
PAKEVGEHL

SEQ ID NO: 4157 - protein, 9 aa, Homo sapiens
FFFLATFCW

SEQ ID NO: 4158 - protein, 9 aa, Homo sapiens
LHFFFLATF

SEQ ID NO: 4159 - protein, 9 aa, Homo sapiens
TAVGVLLVL

SEQ ID NO: 4160 - protein, 9 aa, Homo sapiens
YRKRKLDII

SEQ ID NO: 4161 - protein, 9 aa, Homo sapiens
LSSAGTAVV

SEQ ID NO: 4162 - protein, 9 aa, Homo sapiens
SAGTAVVLI

SEQ ID NO: 4163 - protein, 9 aa, Homo sapiens
IYFRKGPFI

SEQ ID NO: 4164 - protein, 9 aa, Homo sapiens
IYFRKGPFI

SEQ ID NO: 4165 - protein, 9 aa, Homo sapiens
NPKVNAGII

SEQ ID NO: 4166 - protein, 9 aa, Homo sapiens
WFQNAMAKE

SEQ ID NO: 4167 - protein, 9 aa, Homo sapiens
NAMAKEKKF

SEQ ID NO: 4168 - protein, 9 aa, Homo sapiens
MAKEKKFKI

SEQ ID NO: 4169 - protein, 9 aa, Homo sapiens
FYSDEPWTL

SEQ ID NO: 4170 - protein, 9 aa, Homo sapiens
THFYSDEPW

SEQ ID NO: 4171 - protein, 9 aa, Homo sapiens
FYSDEPWTL

SEQ ID NO: 4172 - protein, 9 aa, Homo sapiens
YKKNPNFSI

SEQ ID NO: 4173 - protein, 9 aa, Homo sapiens
ISSDGQNVV

SEQ ID NO: 4174 - protein, 9 aa, Homo sapiens
FSHHKKRLL

SEQ ID NO: 4175 - protein, 9 aa, Homo sapiens
KYRTSGMQF

SEQ ID NO: 4176 - protein, 9 aa, Homo sapiens
RAFALDCEM

SEQ ID NO: 4177 - protein, 9 aa, Homo sapiens
FALDCEMVG

SEQ ID NO: 4178 - protein, 9 aa, Homo sapiens
LMLKDYTEV

SEQ ID NO: 4179 - protein, 9 aa, Homo sapiens
MVVDGVSAY

SEQ ID NO: 4180 - protein, 9 aa, Homo sapiens
MVVDGVSAY

SEQ ID NO: 4181 - protein, 9 aa, Homo sapiens
WVDGVSAYL

SEQ ID NO: 4182 - protein, 9 aa, Homo sapiens
LSFSCGDIL

SEQ ID NO: 4183 - protein, 9 aa, Homo sapiens
FSCGDILHV

SEQ ID NO: 4184 - protein, 9 aa, Homo sapiens
NHRDYSTEL

SEQ ID NO: 4185 - protein, 9 aa, Homo sapiens
MYASIYFLA

SEQ ID NO: 4186 - protein, 9 aa, Homo sapiens
IYFLACISV

SEQ ID NO: 4187 - protein, 9 aa, Homo sapiens
FPLYGQAEL

SEQ ID NO: 4188 - protein, 9 aa, Homo sapiens
YAHIRPTDV

SEQ ID NO: 4189 - protein, 9 aa, Homo sapiens
FEQDFQQHV

SEQ ID NO: 4190 - protein, 9 aa, Homo sapiens
KAEMLDRVI

SEQ ID NO: 4191 - protein, 9 aa, Homo sapiens
MQKAEEKER

SEQ ID NO: 4192 - protein, 9 aa, Homo sapiens
HQGSSRGGR

SEQ ID NO: 4193 - protein, 9 aa, Homo sapiens
KTAAINAYE

SEQ ID NO: 4194 - protein, 9 aa, Homo sapiens
FSVVIRGLR

SEQ ID NO: 4195 - protein, 9 aa, Homo sapiens
HMDNLESRV

SEQ ID NO: 4196 - protein, 9 aa, Homo sapiens
AGDGTHLFF

SEQ ID NO: 4197 - protein, 9 aa, Homo sapiens
RSRKDLRAR

SEQ ID NO: 4198 - protein, 9 aa, Homo sapiens
WENSALLKH

SEQ ID NO: 4199 - protein, 9 aa, Homo sapiens
TEEEIRTSL

SEQ ID NO: 4200 - protein, 9 aa, Homo sapiens
RSKQILSTK

SEQ ID NO: 4201 - protein, 9 aa, Homo sapiens
QILSTKTVR

SEQ ID NO: 4202 - protein, 9 aa, Homo sapiens
ILSFKAEFR

SEQ ID NO: 4203 - protein, 9 aa, Homo sapiens
RQYDQFYLA

SEQ ID NO: 4204 - protein, 9 aa, Homo sapiens
DEKLGDTPL

SEQ ID NO: 4205 - protein, 9 aa, Homo sapiens
RYWSAVTLH

SEQ ID NO: 4206 - protein, 9 aa, Homo sapiens
YIDDHSEEQ

SEQ ID NO: 4207 - protein, 9 aa, Homo sapiens
IVDGVQVAL

SEQ ID NO: 4208 - protein, 9 aa, Homo sapiens
AIASRMEYY

SEQ ID NO: 4209 - protein, 9 aa, Homo sapiens
MEYYLQLPD

SEQ ID NO: 4210 - protein, 9 aa, Homo sapiens
RLADICKEY

SEQ ID NO: 4211 - protein, 9 aa, Homo sapiens
KEYVFEQTR

SEQ ID NO: 4212 - protein, 9 aa, Homo sapiens
YVFEQTRVR

SEQ ID NO: 4213 - protein, 9 aa, Homo sapiens
LADICKEYV

SEQ ID NO: 4214 - protein, 9 aa, Homo sapiens
NTQEMGVKR

SEQ ID NO: 4215 - protein, 9 aa, Homo sapiens
GCQKIIGGY

SEQ ID NO: 4216 - protein, 9 aa, Homo sapiens
CQKIIGGYR

SEQ ID NO: 4217 - protein, 9 aa, Homo sapiens
LTYIMALLY

SEQ ID NO: 4218 - protein, 9 aa, Homo sapiens
ALDPSQLSF

SEQ ID NO: 4219 - protein, 9 aa, Homo sapiens
SMKKLTRKK

SEQ ID NO: 4220 - protein, 9 aa, Homo sapiens
RGGVVQPPR

SEQ ID NO: 4221 - protein, 9 aa, Homo sapiens
RTLRCHRNK

SEQ ID NO: 4222 - protein, 9 aa, Homo sapiens
VELTALWYA

SEQ ID NO: 4223 - protein, 9 aa, Homo sapiens
SSPVLNGQY

SEQ ID NO: 4224 - protein, 9 aa, Homo sapiens
LFHRPRVPR

SEQ ID NO: 4225 - protein, 9 aa, Homo sapiens
LVNEPMAAY

SEQ ID NO: 4226 - protein, 9 aa, Homo sapiens
NEPMAAYSY

SEQ ID NO: 4227 - protein, 9 aa, Homo sapiens
TLDIIRHLR

SEQ ID NO: 4228 - protein, 9 aa, Homo sapiens
ATGKEISKY

SEQ ID NO: 4229 - protein, 9 aa, Homo sapiens
KECGKCFSR

SEQ ID NO: 4230 - protein, 9 aa, Homo sapiens
VSYRGVTYR

SEQ ID NO: 4231 - protein, 9 aa, Homo sapiens
ECDKCGKLF

SEQ ID NO: 4232 - protein, 9 aa, Homo sapiens
CAATMLSLR

SEQ ID NO: 4233 - protein, 9 aa, Homo sapiens
ISVSEKNSY

SEQ ID NO: 4234 - protein, 9 aa, Homo sapiens
LSDSSISVS

SEQ ID NO: 4235 - protein, 9 aa, Homo sapiens
GIWMHRLCK

SEQ ID NO: 4236 - protein, 9 aa, Homo sapiens
WMHRLCKHR

SEQ ID NO: 4237 - protein, 9 aa, Homo sapiens
RLCKHRTGK

SEQ ID NO: 4238 - protein, 9 aa, Homo sapiens
VCKLLCTER

SEQ ID NO: 4239 - protein, 9 aa, Homo sapiens
RIHKLKTNK

SEQ ID NO: 4240 - protein, 9 aa, Homo sapiens
ALSRDCYVY

SEQ ID NO: 4241 - protein, 9 aa, Homo sapiens
LSRDCYVYK

SEQ ID NO: 4242 - protein, 9 aa, Homo sapiens
TEALSRDCY

SEQ ID NO: 4243 - protein, 9 aa, Homo sapiens
TQNAFLNKR

SEQ ID NO: 4244 - protein, 9 aa, Homo sapiens
KGTGLFGER

SEQ ID NO: 4245 - protein, 9 aa, Homo sapiens
DEGDEAIKY

SEQ ID NO: 4246 - protein, 9 aa, Homo sapiens
DSDEGDEAI

SEQ ID NO: 4247 - protein, 9 aa, Homo sapiens
DESEIQDMM

SEQ ID NO: 4248 - protein, 9 aa, Homo sapiens
VTDESEIQD

SEQ ID NO: 4249 - protein, 9 aa, Homo sapiens
RSYVLHHSM

SEQ ID NO: 4250 - protein, 9 aa, Homo sapiens
HSFPSVWKK

SEQ ID NO: 4251 - protein, 9 aa, Homo sapiens
FVSHMNYTF

SEQ ID NO: 4252 - protein, 9 aa, Homo sapiens
VAVSSAVDY

SEQ ID NO: 4253 - protein, 9 aa, Homo sapiens
SSAVDYRSY

SEQ ID NO: 4254 - protein, 9 aa, Homo sapiens
AVSSAVDYR

SEQ ID NO: 4255 - protein, 9 aa, Homo sapiens
TGDGPGSLF

SEQ ID NO: 4256 - protein, 9 aa, Homo sapiens
FEDPFSINY

SEQ ID NO: 4257 - protein, 9 aa, Homo sapiens
FEDPFSINY

SEQ ID NO: 4258 - protein, 9 aa, Homo sapiens
IENYIISPY

SEQ ID NO: 4259 - protein, 9 aa, Homo sapiens
NYIISPYSY

SEQ ID NO: 4260 - protein, 9 aa, Homo sapiens
IISPYSYFR

SEQ ID NO: 4261 - protein, 9 aa, Homo sapiens
YSYFRVLTR

SEQ ID NO: 4262 - protein, 9 aa, Homo sapiens
IENYIISPY

SEQ ID NO: 4263 - protein, 9 aa, Homo sapiens
YIISPYSYF

SEQ ID NO: 4264 - protein, 9 aa, Homo sapiens
PLFTQDMYR

SEQ ID NO: 4265 - protein, 9 aa, Homo sapiens
AFELTLQAR

SEQ ID NO: 4266 - protein, 9 aa, Homo sapiens
KLVYLLRPR

SEQ ID NO: 4267 - protein, 9 aa, Homo sapiens
LTDNFYWTR

SEQ ID NO: 4268 - protein, 9 aa, Homo sapiens
TSHHEMNPY

SEQ ID NO: 4269 - protein, 9 aa, Homo sapiens
YTSGIKANY

SEQ ID NO: 4270 - protein, 9 aa, Homo sapiens
GIKANYWLR

SEQ ID NO: 4271 - protein, 9 aa, Homo sapiens
ANYWLRESR

SEQ ID NO: 4272 - protein, 9 aa, Homo sapiens
SYEDICNKY

SEQ ID NO: 4273 - protein, 9 aa, Homo sapiens
SPGGLHYSY

SEQ ID NO: 4274 - protein, 9 aa, Homo sapiens
ILDTPKEDV

SEQ ID NO: 4275 - protein, 9 aa, Homo sapiens
VAVKEKHTR

SEQ ID NO: 4276 - protein, 9 aa, Homo sapiens
SQKATIKWY

SEQ ID NO: 4277 - protein, 9 aa, Homo sapiens
SVVVVLQGY

SEQ ID NO: 4278 - protein, 9 aa, Homo sapiens
HEMEKEETM

SEQ ID NO: 4279 - protein, 9 aa, Homo sapiens
EADVAMAEL

SEQ ID NO: 4280 - protein, 9 aa, Homo sapiens
GQADIFVNK

SEQ ID NO: 4281 - protein, 9 aa, Homo sapiens
QADIFVNKF

SEQ ID NO: 4282 - protein, 9 aa, Homo sapiens
DEEEVITSG

SEQ ID NO: 4283 - protein, 9 aa, Homo sapiens
HLDEEEVIT

SEQ ID NO: 4284 - protein, 9 aa, Homo sapiens
KTAPSLFTK

SEQ ID NO: 4285 - protein, 9 aa, Homo sapiens
FTDLRNLTF

SEQ ID NO: 4286 - protein, 9 aa, Homo sapiens
VAACSGTWL

SEQ ID NO: 4287 - protein, 9 aa, Homo sapiens
CQRPHGRGR

SEQ ID NO: 4288 - protein, 9 aa, Homo sapiens
SEFQFWYEE

SEQ ID NO: 4289 - protein, 9 aa, Homo sapiens
GYGGAVSTY

SEQ ID NO: 4290 - protein, 9 aa, Homo sapiens
YTDFGGTLS

SEQ ID NO: 4291 - protein, 9 aa, Homo sapiens
EMSAVFHLA

SEQ ID NO: 4292 - protein, 9 aa, Homo sapiens
AQEEATSQA

SEQ ID NO: 4293 - protein, 9 aa, Homo sapiens
ASYEFGPAL

SEQ ID NO: 4294 - protein, 9 aa, Homo sapiens
AASGLLGPV

SEQ ID NO: 4295 - protein, 9 aa, Homo sapiens
LLGPVAQGL

SEQ ID NO: 4296 - protein, 9 aa, Homo sapiens
KKYAEDALL

SEQ ID NO: 4297 - protein, 9 aa, Homo sapiens
KAPEALCPA

SEQ ID NO: 4298 - protein, 9 aa, Homo sapiens
MACPSLQEA

SEQ ID NO: 4299 - protein, 9 aa, Homo sapiens
SVAQFLGWA

SEQ ID NO: 4300 - protein, 9 aa, Homo sapiens
AQFLGWASP

SEQ ID NO: 4301 - protein, 9 aa, Homo sapiens
FLGWASPFV

SEQ ID NO: 4302 - protein, 9 aa, Homo sapiens
WLLTHYVKV

SEQ ID NO: 4303 - protein, 9 aa, Homo sapiens
ETARWLLTH

SEQ ID NO: 4304 - protein, 9 aa, Homo sapiens
LIVARAEAA

SEQ ID NO: 4305 - protein, 9 aa, Homo sapiens
FLAPIAAPV

SEQ ID NO: 4306 - protein, 9 aa, Homo sapiens
LAGDAILSL

SEQ ID NO: 4307 - protein, 9 aa, Homo sapiens
VMPGETNPA

SEQ ID NO: 4308 - protein, 9 aa, Homo sapiens
YLNHPEPPV

SEQ ID NO: 4309 - protein, 9 aa, Homo sapiens
NVRDLLFHA

SEQ ID NO: 4310 - protein, 9 aa, Homo sapiens
MQPIYLPRV

SEQ ID NO: 4311 - protein, 9 aa, Homo sapiens
MTMEGLYLA

SEQ ID NO: 4312 - protein, 9 aa, Homo sapiens
QLHGGLELV

SEQ ID NO: 4313 - protein, 9 aa, Homo sapiens
SLGDRIPYV

SEQ ID NO: 4314 - protein, 9 aa, Homo sapiens
RIPYVIISA

SEQ ID NO: 4315 - protein, 9 aa, Homo sapiens
NQHPQFPAV

SEQ ID NO: 4316 - protein, 9 aa, Homo sapiens
IQVLKDWNM

SEQ ID NO: 4317 - protein, 9 aa, Homo sapiens
RVAAQYMLA

SEQ ID NO: 4318 - protein, 9 aa, Homo sapiens
AQYMLAQEA

SEQ ID NO: 4319 - protein, 9 aa, Homo sapiens
YMLAQEAEM

SEQ ID NO: 4320 - protein, 9 aa, Homo sapiens
IVISLDVPI

SEQ ID NO: 4321 - protein, 9 aa, Homo sapiens
LTAAVIDNV

SEQ ID NO: 4322 - protein, 9 aa, Homo sapiens
NVRLCFHGL

SEQ ID NO: 4323 - protein, 9 aa, Homo sapiens
CLQASLTSV

SEQ ID NO: 4324 - protein, 9 aa, Homo sapiens
AAAAAAPAA

SEQ ID NO: 4325 - protein, 9 aa, Homo sapiens
AAAPAAAAA

SEQ ID NO: 4326 - protein, 9 aa, Homo sapiens
TLEDVLSNV

SEQ ID NO: 4327 - protein, 9 aa, Homo sapiens
LLLGMVGRV

SEQ ID NO: 4328 - protein, 9 aa, Homo sapiens
ATAAGAAAL

SEQ ID NO: 4329 - protein, 9 aa, Homo sapiens
LAPPGALHV

SEQ ID NO: 4330 - protein, 9 aa, Homo sapiens
GALHVYYGA

SEQ ID NO: 4331 - protein, 9 aa, Homo sapiens
YAVSAQGFY

SEQ ID NO: 4332 - protein, 9 aa, Homo sapiens
AAAVSDPER

SEQ ID NO: 4333 - protein, 9 aa, Homo sapiens
SISQEDIAK

SEQ ID NO: 4334 - protein, 9 aa, Homo sapiens
STFPATFLE

SEQ ID NO: 4335 - protein, 9 aa, Homo sapiens
DQEFAVASR

SEQ ID NO: 4336 - protein, 9 aa, Homo sapiens
EVQRCLVER

SEQ ID NO: 4337 - protein, 9 aa, Homo sapiens
QTFKAEPPR

SEQ ID NO: 4338 - protein, 9 aa, Homo sapiens
TLLAPCEAR

SEQ ID NO: 4339 - protein, 9 aa, Homo sapiens
TAYPCEDTR

SEQ ID NO: 4340 - protein, 9 aa, Homo sapiens
LTPELMVSR

SEQ ID NO: 4341 - protein, 9 aa, Homo sapiens
KVDDAMPMF

SEQ ID NO: 4342 - protein, 9 aa, Homo sapiens
LTDYLHAMR

SEQ ID NO: 4343 - protein, 9 aa, Homo sapiens
EGSWIPQAR

SEQ ID NO: 4344 - protein, 9 aa, Homo sapiens
STNVAAWLK

SEQ ID NO: 4345 - protein, 9 aa, Homo sapiens
VAAWLKSLR

SEQ ID NO: 4346 - protein, 9 aa, Homo sapiens
TTTTQEASK

SEQ ID NO: 4347 - protein, 9 aa, Homo sapiens
LVVVVAKPK

SEQ ID NO: 4348 - protein, 9 aa, Homo sapiens
TYQGRYGFR

SEQ ID NO: 4349 - protein, 9 aa, Homo sapiens
LENEITTYR

SEQ ID NO: 4350 - protein, 9 aa, Homo sapiens
ENEITTYRR

SEQ ID NO: 4351 - protein, 9 aa, Homo sapiens
NAQAQVKLR

SEQ ID NO: 4352 - protein, 9 aa, Homo sapiens
AVRTVRVPR

SEQ ID NO: 4353 - protein, 9 aa, Homo sapiens
TVRVPRPLR

SEQ ID NO: 4354 - protein, 9 aa, Homo sapiens
MGTGDEALR

SEQ ID NO: 4355 - protein, 9 aa, Homo sapiens
TAPGIPWQR

SEQ ID NO: 4356 - protein, 9 aa, Homo sapiens
SSNLTTHKR

SEQ ID NO: 4357 - protein, 9 aa, Homo sapiens
SVWEASLCK

SEQ ID NO: 4358 - protein, 9 aa, Homo sapiens
RSTLIEHRR

SEQ ID NO: 4359 - protein, 9 aa, Homo sapiens
LTQENVWLR

SEQ ID NO: 4360 - protein, 9 aa, Homo sapiens
HNEVIGMCR

SEQ ID NO: 4361 - protein, 9 aa, Homo sapiens
HNEMIGVCR

SEQ ID NO: 4362 - protein, 9 aa, Homo sapiens
HLVIHTGEK

SEQ ID NO: 4363 - protein, 9 aa, Homo sapiens
EENIVDFLR

SEQ ID NO: 4364 - protein, 9 aa, Homo sapiens
ENIVDFLRR

SEQ ID NO: 4365 - protein, 9 aa, Homo sapiens
MMAVAFDRY

SEQ ID NO: 4366 - protein, 9 aa, Homo sapiens
SMMAVAFDR

SEQ ID NO: 4367 - protein, 9 aa, Homo sapiens
LSVSCEASR

SEQ ID NO: 4368 - protein, 9 aa, Homo sapiens
NSNPEQDSK

SEQ ID NO: 4369 - protein, 9 aa, Homo sapiens
YVAAECPSK

SEQ ID NO: 4370 - protein, 9 aa, Homo sapiens
CNECGKFFR

SEQ ID NO: 4371 - protein, 9 aa, Homo sapiens
YLDSQGNPY

SEQ ID NO: 4372 - protein, 9 aa, Homo sapiens
LTGKLQALR

SEQ ID NO: 4373 - protein, 9 aa, Homo sapiens
STSVQVLVR

SEQ ID NO: 4374 - protein, 9 aa, Homo sapiens
IYTIMHWFR

SEQ ID NO: 4375 - protein, 9 aa, Homo sapiens
YTIMHWFRR

SEQ ID NO: 4376 - protein, 9 aa, Homo sapiens
EECGKVFSR

SEQ ID NO: 4377 - protein, 9 aa, Homo sapiens
SSDAWLEGV

SEQ ID NO: 4378 - protein, 9 aa, Homo sapiens
SLRVATSLR

SEQ ID NO: 4379 - protein, 9 aa, Homo sapiens
MVATIMVLV

SEQ ID NO: 4380 - protein, 9 aa, Homo sapiens
LAEELNHER

SEQ ID NO: 4381 - protein, 9 aa, Homo sapiens
SPDAPDHTL

SEQ ID NO: 4382 - protein, 9 aa, Homo sapiens
LETSHSPLY

SEQ ID NO: 4383 - protein, 9 aa, Homo sapiens
LPLTESRQL

SEQ ID NO: 4384 - protein, 9 aa, Homo sapiens
LPLTESRQL

SEQ ID NO: 4385 - protein, 9 aa, Homo sapiens
DPLEATDSL

SEQ ID NO: 4386 - protein, 9 aa, Homo sapiens
GPREQNTYV

SEQ ID NO: 4387 - protein, 9 aa, Homo sapiens
ATQLSEGYY

SEQ ID NO: 4388 - protein, 9 aa, Homo sapiens
VATQLSEGY

SEQ ID NO: 4389 - protein, 9 aa, Homo sapiens
ISLLDDTVY

SEQ ID NO: 4390 - protein, 9 aa, Homo sapiens
APNLNMSSS

SEQ ID NO: 4391 - protein, 9 aa, Homo sapiens
FPGPPIHWL

SEQ ID NO: 4392 - protein, 9 aa, Homo sapiens
LPTAEHHPE

SEQ ID NO: 4393 - protein, 9 aa, Homo sapiens
TGKSFLMNK

SEQ ID NO: 4394 - protein, 9 aa, Homo sapiens
FLMNKLAGK

SEQ ID NO: 4395 - protein, 9 aa, Homo sapiens
YRTGKSFLM

SEQ ID NO: 4396 - protein, 9 aa, Homo sapiens
HPNEQKEGM

SEQ ID NO: 4397 - protein, 9 aa, Homo sapiens
MPAPFGDQS

SEQ ID NO: 4398 - protein, 9 aa, Homo sapiens
WSEEEEHGY

SEQ ID NO: 4399 - protein, 9 aa, Homo sapiens
WSEEEEHGY

SEQ ID NO: 4400 - protein, 9 aa, Homo sapiens
SYENVPRVL

SEQ ID NO: 4401 - protein, 9 aa, Homo sapiens
ITHVTLLIY

SEQ ID NO: 4402 - protein, 9 aa, Homo sapiens
AVCESMYQK

SEQ ID NO: 4403 - protein, 9 aa, Homo sapiens
QIAVCESMY

SEQ ID NO: 4404 - protein, 9 aa, Homo sapiens
MYQKLCEIL

SEQ ID NO: 4405 - protein, 9 aa, Homo sapiens
RILAPNRNY

SEQ ID NO: 4406 - protein, 9 aa, Homo sapiens
APNRNYQDV

SEQ ID NO: 4407 - protein, 9 aa, Homo sapiens
ITANASDAY

SEQ ID NO: 4408 - protein, 9 aa, Homo sapiens
ITANASDAY

SEQ ID NO: 4409 - protein, 9 aa, Homo sapiens
TANASDAYL

SEQ ID NO: 4410 - protein, 9 aa, Homo sapiens
KVKFENFNK

SEQ ID NO: 4411 - protein, 9 aa, Homo sapiens
RMPEDQVAK

SEQ ID NO: 4412 - protein, 9 aa, Homo sapiens
PLYVGNRMK

SEQ ID NO: 4413 - protein, 9 aa, Homo sapiens
EPLYVGNRM

SEQ ID NO: 4414 - protein, 9 aa, Homo sapiens
MTLFLSMNR

SEQ ID NO: 4415 - protein, 9 aa, Homo sapiens
ALSWSRLPR

SEQ ID NO: 4416 - protein, 9 aa, Homo sapiens
QSAESSDAL

SEQ ID NO: 4417 - protein, 9 aa, Homo sapiens
VTYPKKAGR

SEQ ID NO: 4418 - protein, 9 aa, Homo sapiens
YPKKAGRPG

SEQ ID NO: 4419 - protein, 9 aa, Homo sapiens
MVRWSQESV

SEQ ID NO: 4420 - protein, 9 aa, Homo sapiens
VRWSQESVI

SEQ ID NO: 4421 - protein, 9 aa, Homo sapiens
AAVCHTLRY

SEQ ID NO: 4422 - protein, 9 aa, Homo sapiens
TLFYGASLY

SEQ ID NO: 4423 - protein, 9 aa, Homo sapiens
TLFYGASLY

SEQ ID NO: 4424 - protein, 9 aa, Homo sapiens
FYGASLYTY

SEQ ID NO: 4425 - protein, 9 aa, Homo sapiens
FYGASLYTY

SEQ ID NO: 4426 - protein, 9 aa, Homo sapiens
HPMFCASLA

SEQ ID NO: 4427 - protein, 9 aa, Homo sapiens
YIAIMHPMF

SEQ ID NO: 4428 - protein, 9 aa, Homo sapiens
HPMFCASLA

SEQ ID NO: 4429 - protein, 9 aa, Homo sapiens
RYIAIMHPM

SEQ ID NO: 4430 - protein, 9 aa, Homo sapiens
RARGQVLTK

SEQ ID NO: 4431 - protein, 9 aa, Homo sapiens
KLRARGQVL

SEQ ID NO: 4432 - protein, 9 aa, Homo sapiens
LPVLAKIAA

SEQ ID NO: 4433 - protein, 9 aa, Homo sapiens
LPVLAKIAA

SEQ ID NO: 4434 - protein, 9 aa, Homo sapiens
CAMAVLFTK

SEQ ID NO: 4435 - protein, 9 aa, Homo sapiens
KAFRKSSTF

SEQ ID NO: 4436 - protein, 9 aa, Homo sapiens
AVLSRTAPK

SEQ ID NO: 4437 - protein, 9 aa, Homo sapiens
APKGPGSRC

SEQ ID NO: 4438 - protein, 9 aa, Homo sapiens
LSLLTSLDY

SEQ ID NO: 4439 - protein, 9 aa, Homo sapiens
LLPPPTILK

SEQ ID NO: 4440 - protein, 9 aa, Homo sapiens
VLLPPPTIL

SEQ ID NO: 4441 - protein, 9 aa, Homo sapiens
QPGNTRVTI

SEQ ID NO: 4442 - protein, 9 aa, Homo sapiens
MYVAIQVVL

SEQ ID NO: 4443 - protein, 9 aa, Homo sapiens
APRGLHVLT

SEQ ID NO: 4444 - protein, 9 aa, Homo sapiens
KILLEHCSK

SEQ ID NO: 4445 - protein, 9 aa, Homo sapiens
CSKHKYLAK

SEQ ID NO: 4446 - protein, 9 aa, Homo sapiens
VPHNPAPPT

SEQ ID NO: 4447 - protein, 9 aa, Homo sapiens
NPAPPTSTV

SEQ ID NO: 4448 - protein, 9 aa, Homo sapiens
YAQACHDAV

SEQ ID NO: 4449 - protein, 9 aa, Homo sapiens
RVNLGFQAL

SEQ ID NO: 4450 - protein, 9 aa, Homo sapiens
PPRECGAHI

SEQ ID NO: 4451 - protein, 9 aa, Homo sapiens
LLAFFSFFK

SEQ ID NO: 4452 - protein, 9 aa, Homo sapiens
FFSFFKHRF

SEQ ID NO: 4453 - protein, 9 aa, Homo sapiens
HIWFGVPFF

SEQ ID NO: 4454 - protein, 9 aa, Homo sapiens
FGVPFFFVY

SEQ ID NO: 4455 - protein, 9 aa, Homo sapiens
RIQSGLSAL

SEQ ID NO: 4456 - protein, 9 aa, Homo sapiens
HPWADTAPP

SEQ ID NO: 4457 - protein, 9 aa, Homo sapiens
IFFPCASGI

SEQ ID NO: 4458 - protein, 9 aa, Homo sapiens
YLQKFMNAY

SEQ ID NO: 4459 - protein, 9 aa, Homo sapiens
FMNAYNALK

SEQ ID NO: 4460 - protein, 9 aa, Homo sapiens
YLQKFMNAY

SEQ ID NO: 4461 - protein, 9 aa, Homo sapiens
KFMNAYNAL

SEQ ID NO: 4462 - protein, 9 aa, Homo sapiens
SPRVCFLMV

SEQ ID NO: 4463 - protein, 9 aa, Homo sapiens
IIMSPRVCF

SEQ ID NO: 4464 - protein, 9 aa, Homo sapiens
IMSPRVCFL

SEQ ID NO: 4465 - protein, 9 aa, Homo sapiens
LALMACDRY

SEQ ID NO: 4466 - protein, 9 aa, Homo sapiens
MANTNGSAI

SEQ ID NO: 4467 - protein, 9 aa, Homo sapiens
MANTNGSAI

SEQ ID NO: 4468 - protein, 9 aa, Homo sapiens
FPFIYIFTL

SEQ ID NO: 4469 - protein, 9 aa, Homo sapiens
ITFPFIYIF

SEQ ID NO: 4470 - protein, 9 aa, Homo sapiens
FPFIYIFTL

SEQ ID NO: 4471 - protein, 9 aa, Homo sapiens
HFVHCVYIY

SEQ ID NO: 4472 - protein, 9 aa, Homo sapiens
HFVHCVYIY

SEQ ID NO: 4473 - protein, 9 aa, Homo sapiens
YPFLGAVCF

SEQ ID NO: 4474 - protein, 9 aa, Homo sapiens
RLRSVAFPF

SEQ ID NO: 4475 - protein, 9 aa, Homo sapiens
FPFISTGVF

SEQ ID NO: 4476 - protein, 9 aa, Homo sapiens
FPFISTGVF

SEQ ID NO: 4477 - protein, 9 aa, Homo sapiens
FISTGVFGY

SEQ ID NO: 4478 - protein, 9 aa, Homo sapiens
RLRSVAFPF

SEQ ID NO: 4479 - protein, 9 aa, Homo sapiens
MLLSSEQLF

SEQ ID NO: 4480 - protein, 9 aa, Homo sapiens
KRLEAYMLL

SEQ ID NO: 4481 - protein, 9 aa, Homo sapiens
NFYPERFAY

SEQ ID NO: 4482 - protein, 9 aa, Homo sapiens
NFYPERFAY

SEQ ID NO: 4483 - protein, 9 aa, Homo sapiens
DMVLCSPEM

SEQ ID NO: 4484 - protein, 9 aa, Homo sapiens
SMDALLGGY

SEQ ID NO: 4485 - protein, 9 aa, Homo sapiens
KHKPYQMTI

SEQ ID NO: 4486 - protein, 9 aa, Homo sapiens
VSLCYGLTY

SEQ ID NO: 4487 - protein, 9 aa, Homo sapiens
IFGPHWMAF

SEQ ID NO: 4488 - protein, 9 aa, Homo sapiens
TLRNKEVQK

SEQ ID NO: 4489 - protein, 9 aa, Homo sapiens
HYFCDLFPF

SEQ ID NO: 4490 - protein, 9 aa, Homo sapiens
FPFLGLSCS

SEQ ID NO: 4491 - protein, 9 aa, Homo sapiens
HYFCDLFPF

SEQ ID NO: 4492 - protein, 9 aa, Homo sapiens
YFCDLFPFL

SEQ ID NO: 4493 - protein, 9 aa, Homo sapiens
DTQENVMKY

SEQ ID NO: 4494 - protein, 9 aa, Homo sapiens
NVMKYLHVL

SEQ ID NO: 4495 - protein, 9 aa, Homo sapiens
MPATPNFPA

SEQ ID NO: 4496 - protein, 9 aa, Homo sapiens
FPANPSSSS

SEQ ID NO: 4497 - protein, 9 aa, Homo sapiens
MPATPNFPA

SEQ ID NO: 4498 - protein, 9 aa, Homo sapiens
FPANPSSSS

SEQ ID NO: 4499 - protein, 9 aa, Homo sapiens
APEHSNNKM

SEQ ID NO: 4500 - protein, 9 aa, Homo sapiens
PLTHSLSNK

SEQ ID NO: 4501 - protein, 9 aa, Homo sapiens
LPLTHSLSN

SEQ ID NO: 4502 - protein, 9 aa, Homo sapiens
FLFNENFLL

SEQ ID NO: 4503 - protein, 9 aa, Homo sapiens
YLSHGASLR

SEQ ID NO: 4504 - protein, 9 aa, Homo sapiens
TAMLPTVRM

SEQ ID NO: 4505 - protein, 9 aa, Homo sapiens
LAVLLSLCF

SEQ ID NO: 4506 - protein, 9 aa, Homo sapiens
NPNQRLPMV

SEQ ID NO: 4507 - protein, 9 aa, Homo sapiens
QRLPMVEIL

SEQ ID NO: 4508 - protein, 9 aa, Homo sapiens
DMMPKYLSF

SEQ ID NO: 4509 - protein, 9 aa, Homo sapiens
MPKYLSFVK

SEQ ID NO: 4510 - protein, 9 aa, Homo sapiens
SPVPIITPI

SEQ ID NO: 4511 - protein, 9 aa, Homo sapiens
SPVPIITPI

SEQ ID NO: 4512 - protein, 9 aa, Homo sapiens
RVRLELKTK

SEQ ID NO: 4513 - protein, 9 aa, Homo sapiens
RPHVARKPR

SEQ ID NO: 4514 - protein, 9 aa, Homo sapiens
VARKPRAGA

SEQ ID NO: 4515 - protein, 9 aa, Homo sapiens
TVLFSNAHK

SEQ ID NO: 4516 - protein, 9 aa, Homo sapiens
SLYCPFFTL

SEQ ID NO: 4517 - protein, 9 aa, Homo sapiens
KMDDPSISR

SEQ ID NO: 4518 - protein, 9 aa, Homo sapiens
VANTSTQTM

SEQ ID NO: 4519 - protein, 9 aa, Homo sapiens
NMYQSRLRR

SEQ ID NO: 4520 - protein, 9 aa, Homo sapiens
MYQSRLRRI

SEQ ID NO: 4521 - protein, 9 aa, Homo sapiens
SSSHPSPRK

SEQ ID NO: 4522 - protein, 9 aa, Homo sapiens
FSMDDSSSH

SEQ ID NO: 4523 - protein, 9 aa, Homo sapiens
LVVRKTISF

SEQ ID NO: 4524 - protein, 9 aa, Homo sapiens
IPFAVILPF

SEQ ID NO: 4525 - protein, 9 aa, Homo sapiens
IPFAVILPF

SEQ ID NO: 4526 - protein, 9 aa, Homo sapiens
FQIPFAVIL

SEQ ID NO: 4527 - protein, 9 aa, Homo sapiens
CPSGSSRAS

SEQ ID NO: 4528 - protein, 9 aa, Homo sapiens
LPLWRALGF

SEQ ID NO: 4529 - protein, 9 aa, Homo sapiens
LPLWRALGF

SEQ ID NO: 4530 - protein, 9 aa, Homo sapiens
AQYAYTGAR

SEQ ID NO: 4531 - protein, 9 aa, Homo sapiens
TLFKSLIDR

SEQ ID NO: 4532 - protein, 9 aa, Homo sapiens
LFKSLIDRF

SEQ ID NO: 4533 - protein, 9 aa, Homo sapiens
DVLAQQFAF

SEQ ID NO: 4534 - protein, 9 aa, Homo sapiens
FAFMAPLLF

SEQ ID NO: 4535 - protein, 9 aa, Homo sapiens
QFAFMAPLL

SEQ ID NO: 4536 - protein, 9 aa, Homo sapiens
KALIIVAVK

SEQ ID NO: 4537 - protein, 9 aa, Homo sapiens
LSDEFRKEY

SEQ ID NO: 4538 - protein, 9 aa, Homo sapiens
EFRKEYYAL

SEQ ID NO: 4539 - protein, 9 aa, Homo sapiens
IKWPSHGAF

SEQ ID NO: 4540 - protein, 9 aa, Homo sapiens
RQMKTHMHK

SEQ ID NO: 4541 - protein, 9 aa, Homo sapiens
VPRFSFAAP

SEQ ID NO: 4542 - protein, 9 aa, Homo sapiens
ASVDVSALK

SEQ ID NO: 4543 - protein, 9 aa, Homo sapiens
QASVDVSAL

SEQ ID NO: 4544 - protein, 9 aa, Homo sapiens
ISARNSLTK

SEQ ID NO: 4545 - protein, 9 aa, Homo sapiens
ALIAWTAQR

SEQ ID NO: 4546 - protein, 9 aa, Homo sapiens
LIAWTAQRF

SEQ ID NO: 4547 - protein, 9 aa, Homo sapiens
KSGFGNSGK

SEQ ID NO: 4548 - protein, 9 aa, Homo sapiens
FASEHALLI

SEQ ID NO: 4549 - protein, 9 aa, Homo sapiens
RPIRSRSAA

SEQ ID NO: 4550 - protein, 9 aa, Homo sapiens
AAVMPKVSL

SEQ ID NO: 4551 - protein, 9 aa, Homo sapiens
SLYGTKGLK

SEQ ID NO: 4552 - protein, 9 aa, Homo sapiens
FVNNNAQEY

SEQ ID NO: 4553 - protein, 9 aa, Homo sapiens
FVNNNAQEY

SEQ ID NO: 4554 - protein, 9 aa, Homo sapiens
CRLRRKLAL

SEQ ID NO: 4555 - protein, 9 aa, Homo sapiens
YPHPLPSPV

SEQ ID NO: 4556 - protein, 9 aa, Homo sapiens
HPLPSPVGV

SEQ ID NO: 4557 - protein, 9 aa, Homo sapiens
YPHPLPSPV

SEQ ID NO: 4558 - protein, 9 aa, Homo sapiens
LPSPVGVLY

SEQ ID NO: 4559 - protein, 9 aa, Homo sapiens
SPVGVLYTW

SEQ ID NO: 4560 - protein, 9 aa, Homo sapiens
IPAAPRKPS

SEQ ID NO: 4561 - protein, 9 aa, Homo sapiens
HASCHVEFF

SEQ ID NO: 4562 - protein, 9 aa, Homo sapiens
QIDETRMCY

SEQ ID NO: 4563 - protein, 9 aa, Homo sapiens
VVQASQGGK

SEQ ID NO: 4564 - protein, 9 aa, Homo sapiens
QASQGGKLF

SEQ ID NO: 4565 - protein, 9 aa, Homo sapiens
LAVIALVAL

SEQ ID NO: 4566 - protein, 9 aa, Homo sapiens
CVVAWLPSM

SEQ ID NO: 4567 - protein, 9 aa, Homo sapiens
MPGPAAVSR

SEQ ID NO: 4568 - protein, 9 aa, Homo sapiens
AAVSRARVY

SEQ ID NO: 4569 - protein, 9 aa, Homo sapiens
YAHNHGVYL

SEQ ID NO: 4570 - protein, 9 aa, Homo sapiens
LPGSPAYAH

SEQ ID NO: 4571 - protein, 9 aa, Homo sapiens
YAHNHGVYL

SEQ ID NO: 4572 - protein, 9 aa, Homo sapiens
HVRIAEAAK

SEQ ID NO: 4573 - protein, 9 aa, Homo sapiens
RIAEAAKLK

SEQ ID NO: 4574 - protein, 9 aa, Homo sapiens
KLKPPPFLR

SEQ ID NO: 4575 - protein, 9 aa, Homo sapiens
ILACRNMAK

SEQ ID NO: 4576 - protein, 9 aa, Homo sapiens
GLDVGLTGK

SEQ ID NO: 4577 - protein, 9 aa, Homo sapiens
YHYKDVWVL

SEQ ID NO: 4578 - protein, 9 aa, Homo sapiens
MPQVAVDVL

SEQ ID NO: 4579 - protein, 9 aa, Homo sapiens
MPQVAVDVL

SEQ ID NO: 4580 - protein, 9 aa, Homo sapiens
VAVDVLQRM

SEQ ID NO: 4581 - protein, 9 aa, Homo sapiens
HLHETAVLY

SEQ ID NO: 4582 - protein, 9 aa, Homo sapiens
HLHETAVLY

SEQ ID NO: 4583 - protein, 9 aa, Homo sapiens
LLLALSLPF

SEQ ID NO: 4584 - protein, 9 aa, Homo sapiens
LALSLPFAA

SEQ ID NO: 4585 - protein, 9 aa, Homo sapiens
SPTRNRTPF

SEQ ID NO: 4586 - protein, 9 aa, Homo sapiens
SPTRNRTPF

SEQ ID NO: 4587 - protein, 9 aa, Homo sapiens
HAMFGNVTI

SEQ ID NO: 4588 - protein, 9 aa, Homo sapiens
KVRYGVAIL

SEQ ID NO: 4589 - protein, 9 aa, Homo sapiens
LSTGLGSTY

SEQ ID NO: 4590 - protein, 9 aa, Homo sapiens
YPDQQHVAS

SEQ ID NO: 4591 - protein, 9 aa, Homo sapiens
KVKAHRTSL

SEQ ID NO: 4592 - protein, 9 aa, Homo sapiens
LSDRTMLLE

SEQ ID NO: 4593 - protein, 9 aa, Homo sapiens
KPPLSDRTM

SEQ ID NO: 4594 - protein, 9 aa, Homo sapiens
PPLSDRTML

SEQ ID NO: 4595 - protein, 9 aa, Homo sapiens
SIIDPSSVM

SEQ ID NO: 4596 - protein, 9 aa, Homo sapiens
LVAGAGSTF

SEQ ID NO: 4597 - protein, 9 aa, Homo sapiens
LVAGAGSTF

SEQ ID NO: 4598 - protein, 9 aa, Homo sapiens
RSLDHLHPK

SEQ ID NO: 4599 - protein, 9 aa, Homo sapiens
AVAAAEAAV

SEQ ID NO: 4600 - protein, 9 aa, Homo sapiens
EAVAAAEAA

SEQ ID NO: 4601 - protein, 9 aa, Homo sapiens
RLMDQQQRL

SEQ ID NO: 4602 - protein, 9 aa, Homo sapiens
TPLTATGSA

SEQ ID NO: 4603 - protein, 9 aa, Homo sapiens
LTATGSAEM

SEQ ID NO: 4604 - protein, 9 aa, Homo sapiens
SVPTPTQAK

SEQ ID NO: 4605 - protein, 9 aa, Homo sapiens
RPIRTFSTM

SEQ ID NO: 4606 - protein, 9 aa, Homo sapiens
RPIRTFSTM

SEQ ID NO: 4607 - protein, 9 aa, Homo sapiens
RVKSTISSL

SEQ ID NO: 4608 - protein, 9 aa, Homo sapiens
MFMSTMDVL

SEQ ID NO: 4609 - protein, 9 aa, Homo sapiens
RLAATNCRK

SEQ ID NO: 4610 - protein, 9 aa, Homo sapiens
EAAWTLLEL

SEQ ID NO: 4611 - protein, 9 aa, Homo sapiens
QPSGELFAI

SEQ ID NO: 4612 - protein, 9 aa, Homo sapiens
EFQPSGELF

SEQ ID NO: 4613 - protein, 9 aa, Homo sapiens
ALRLAAVVL

SEQ ID NO: 4614 - protein, 9 aa, Homo sapiens
KATARALGK

SEQ ID NO: 4615 - protein, 9 aa, Homo sapiens
VVGGPSVSL

SEQ ID NO: 4616 - protein, 9 aa, Homo sapiens
ELGAYYMKK

SEQ ID NO: 4617 - protein, 9 aa, Homo sapiens
QPAQYSWTI

SEQ ID NO: 4618 - protein, 9 aa, Homo sapiens
TPAQYSWTI

SEQ ID NO: 4619 - protein, 9 aa, Homo sapiens
TPAQYSWTI

SEQ ID NO: 4620 - protein, 9 aa, Homo sapiens
MGFMCEVKK

SEQ ID NO: 4621 - protein, 9 aa, Homo sapiens
APAGQGAEA

SEQ ID NO: 4622 - protein, 9 aa, Homo sapiens
HLSQPPLMK

SEQ ID NO: 4623 - protein, 9 aa, Homo sapiens
WPHLSQPPL

SEQ ID NO: 4624 - protein, 9 aa, Homo sapiens
WPHLSQPPL

SEQ ID NO: 4625 - protein, 9 aa, Homo sapiens
KMRPISGVM

SEQ ID NO: 4626 - protein, 9 aa, Homo sapiens
KMRPISGVM

SEQ ID NO: 4627 - protein, 9 aa, Homo sapiens
IPVATNNPV

SEQ ID NO: 4628 - protein, 9 aa, Homo sapiens
IPVATNNPV

SEQ ID NO: 4629 - protein, 9 aa, Homo sapiens
SPVPASPVS

SEQ ID NO: 4630 - protein, 9 aa, Homo sapiens
APLSPSSPI

SEQ ID NO: 4631 - protein, 9 aa, Homo sapiens
QPLRARSPL

SEQ ID NO: 4632 - protein, 9 aa, Homo sapiens
QPLRARSPL

SEQ ID NO: 4633 - protein, 9 aa, Homo sapiens
KTFNSFLRR

SEQ ID NO: 4634 - protein, 9 aa, Homo sapiens
SVQGHGTWL

SEQ ID NO: 4635 - protein, 9 aa, Homo sapiens
FPGVLMGPV

SEQ ID NO: 4636 - protein, 9 aa, Homo sapiens
FPGVLMGPV

SEQ ID NO: 4637 - protein, 9 aa, Homo sapiens
KPHCITVRA

SEQ ID NO: 4638 - protein, 9 aa, Homo sapiens
IVHNGKHFK

SEQ ID NO: 4639 - protein, 9 aa, Homo sapiens
SPAESEFNY

SEQ ID NO: 4640 - protein, 9 aa, Homo sapiens
NPYPYSHAI

SEQ ID NO: 4641 - protein, 9 aa, Homo sapiens
NPYPYSHAI

SEQ ID NO: 4642 - protein, 9 aa, Homo sapiens
YPYSHAINT

SEQ ID NO: 4643 - protein, 9 aa, Homo sapiens
LTNFSCQAK

SEQ ID NO: 4644 - protein, 9 aa, Homo sapiens
SRSPTMLPV

SEQ ID NO: 4645 - protein, 9 aa, Homo sapiens
DVISGSQLY

SEQ ID NO: 4646 - protein, 9 aa, Homo sapiens
NLSAIVLEK

SEQ ID NO: 4647 - protein, 9 aa, Homo sapiens
LGVPTGLPY

SEQ ID NO: 4648 - protein, 9 aa, Homo sapiens
LPYNVDTES

SEQ ID NO: 4649 - protein, 9 aa, Homo sapiens
GMLRYLLLR

SEQ ID NO: 4650 - protein, 9 aa, Homo sapiens
RTVLGANSK

SEQ ID NO: 4651 - protein, 9 aa, Homo sapiens
EAAVIPVSF

SEQ ID NO: 4652 - protein, 9 aa, Homo sapiens
CPFQESTEL

SEQ ID NO: 4653 - protein, 9 aa, Homo sapiens
QLRQTVCKK

SEQ ID NO: 4654 - protein, 9 aa, Homo sapiens
HTIPWDVKK

SEQ ID NO: 4655 - protein, 9 aa, Homo sapiens
QPRYFMYAY

SEQ ID NO: 4656 - protein, 9 aa, Homo sapiens
RVKTHFQPR

SEQ ID NO: 4657 - protein, 9 aa, Homo sapiens
KPTGGGRCT

SEQ ID NO: 4658 - protein, 9 aa, Homo sapiens
GRSPPVLPL

SEQ ID NO: 4659 - protein, 9 aa, Homo sapiens
EAQRTSGAF

SEQ ID NO: 4660 - protein, 9 aa, Homo sapiens
SPPPKDTML

SEQ ID NO: 4661 - protein, 9 aa, Homo sapiens
QAAYADSGY

SEQ ID NO: 4662 - protein, 9 aa, Homo sapiens
AAYADSGYF

SEQ ID NO: 4663 - protein, 9 aa, Homo sapiens
YADSGYFLH

SEQ ID NO: 4664 - protein, 9 aa, Homo sapiens
RVRLRKVLK

SEQ ID NO: 4665 - protein, 9 aa, Homo sapiens
KTRVHRSKK

SEQ ID NO: 4666 - protein, 9 aa, Homo sapiens
VPVPVVSAL

SEQ ID NO: 4667 - protein, 9 aa, Homo sapiens
EPDYVTVPV

SEQ ID NO: 4668 - protein, 9 aa, Homo sapiens
VPVPVVSAL

SEQ ID NO: 4669 - protein, 9 aa, Homo sapiens
KPGVRVALV

SEQ ID NO: 4670 - protein, 9 aa, Homo sapiens
HLAVVSMCY

SEQ ID NO: 4671 - protein, 9 aa, Homo sapiens
VVSMCYSSL

SEQ ID NO: 4672 - protein, 9 aa, Homo sapiens
HLAVVSMCY

SEQ ID NO: 4673 - protein, 9 aa, Homo sapiens
MCYSSLMVM

SEQ ID NO: 4674 - protein, 9 aa, Homo sapiens
ISDPVLLVA

SEQ ID NO: 4675 - protein, 9 aa, Homo sapiens
LLVATTIQY

SEQ ID NO: 4676 - protein, 9 aa, Homo sapiens
RRHTQFDPF

SEQ ID NO: 4677 - protein, 9 aa, Homo sapiens
DALVCSCFM

SEQ ID NO: 4678 - protein, 9 aa, Homo sapiens
LVCSCFMPF

SEQ ID NO: 4679 - protein, 9 aa, Homo sapiens
MPFYSGLIP

SEQ ID NO: 4680 - protein, 9 aa, Homo sapiens
CFMPFYSGL

SEQ ID NO: 4681 - protein, 9 aa, Homo sapiens
AARARWRAW

SEQ ID NO: 4682 - protein, 9 aa, Homo sapiens
GMGAAVMRY

SEQ ID NO: 4683 - protein, 9 aa, Homo sapiens
LLRGMGAAV

SEQ ID NO: 4684 - protein, 9 aa, Homo sapiens
YRFDLLRGM

SEQ ID NO: 4685 - protein, 9 aa, Homo sapiens
VYLMFFLLK

SEQ ID NO: 4686 - protein, 9 aa, Homo sapiens
MFFLLKFSK

SEQ ID NO: 4687 - protein, 9 aa, Homo sapiens
YLMFFLLKF

SEQ ID NO: 4688 - protein, 9 aa, Homo sapiens
PPNGYMTDL

SEQ ID NO: 4689 - protein, 9 aa, Homo sapiens
FIANPPNGY

SEQ ID NO: 4690 - protein, 9 aa, Homo sapiens
LAQGLALAL

SEQ ID NO: 4691 - protein, 9 aa, Homo sapiens
EPAGAWLAQ

SEQ ID NO: 4692 - protein, 9 aa, Homo sapiens
LAQGLALAL

SEQ ID NO: 4693 - protein, 9 aa, Homo sapiens
FYGGKVHRI

SEQ ID NO: 4694 - protein, 9 aa, Homo sapiens
IPQEKENIF

SEQ ID NO: 4695 - protein, 9 aa, Homo sapiens
ILAIVTMAY

SEQ ID NO: 4696 - protein, 9 aa, Homo sapiens
ILAIVTMAY

SEQ ID NO: 4697 - protein, 9 aa, Homo sapiens
ILAIVTMAY

SEQ ID NO: 4698 - protein, 9 aa, Homo sapiens
YMNLGPSTL

SEQ ID NO: 4699 - protein, 9 aa, Homo sapiens
VLYVDSWAR

SEQ ID NO: 4700 - protein, 9 aa, Homo sapiens
YRPEECKAL

SEQ ID NO: 4701 - protein, 9 aa, Homo sapiens
ASVNSCAVK

SEQ ID NO: 4702 - protein, 9 aa, Homo sapiens
NPDNRFTDL

SEQ ID NO: 4703 - protein, 9 aa, Homo sapiens
YASYDTINL

SEQ ID NO: 4704 - protein, 9 aa, Homo sapiens
SLKLSNLYK

SEQ ID NO: 4705 - protein, 9 aa, Homo sapiens
ESLKLSNLY

SEQ ID NO: 4706 - protein, 9 aa, Homo sapiens
QIYSWKKVK

SEQ ID NO: 4707 - protein, 9 aa, Homo sapiens
RVLPRALFR

SEQ ID NO: 4708 - protein, 9 aa, Homo sapiens
RLRVLPRAL

SEQ ID NO: 4709 - protein, 9 aa, Homo sapiens
LRRNRLRVL

SEQ ID NO: 4710 - protein, 9 aa, Homo sapiens
LRVLPRALF

SEQ ID NO: 4711 - protein, 9 aa, Homo sapiens
VTHACSHIY

SEQ ID NO: 4712 - protein, 9 aa, Homo sapiens
HIYCVHFIL

SEQ ID NO: 4713 - protein, 9 aa, Homo sapiens
LPSRVGALI

SEQ ID NO: 4714 - protein, 9 aa, Homo sapiens
RVGALIGVL

SEQ ID NO: 4715 - protein, 9 aa, Homo sapiens
LTDFFQASK

SEQ ID NO: 4716 - protein, 9 aa, Homo sapiens
NVEELTDFF

SEQ ID NO: 4717 - protein, 9 aa, Homo sapiens
SASSSLGSL

SEQ ID NO: 4718 - protein, 9 aa, Homo sapiens
QPVEASASS

SEQ ID NO: 4719 - protein, 9 aa, Homo sapiens
MSGAGDSDY

SEQ ID NO: 4720 - protein, 9 aa, Homo sapiens
MSGAGDSDY

SEQ ID NO: 4721 - protein, 9 aa, Homo sapiens
RLLKRTPRR

SEQ ID NO: 4722 - protein, 9 aa, Homo sapiens
RASTHDSSL

SEQ ID NO: 4723 - protein, 9 aa, Homo sapiens
SLTQEELNK

SEQ ID NO: 4724 - protein, 9 aa, Homo sapiens
SREAYGSAL

SEQ ID NO: 4725 - protein, 9 aa, Homo sapiens
TPEMYKTML

SEQ ID NO: 4726 - protein, 9 aa, Homo sapiens
ILEFKPSNK

SEQ ID NO: 4727 - protein, 9 aa, Homo sapiens
AMFWIEFVM

SEQ ID NO: 4728 - protein, 9 aa, Homo sapiens
TVLASSVTL

SEQ ID NO: 4729 - protein, 9 aa, Homo sapiens
LPNLHPSFI

SEQ ID NO: 4730 - protein, 9 aa, Homo sapiens
SHPPTVVRL

SEQ ID NO: 4731 - protein, 9 aa, Homo sapiens
LPEATPTEL

SEQ ID NO: 4732 - protein, 9 aa, Homo sapiens
LPEATPTEL

SEQ ID NO: 4733 - protein, 9 aa, Homo sapiens
TSTQHHFSF

SEQ ID NO: 4734 - protein, 9 aa, Homo sapiens
SFQNAERAF

SEQ ID NO: 4735 - protein, 9 aa, Homo sapiens
EPTQITAPG

SEQ ID NO: 4736 - protein, 9 aa, Homo sapiens
NRTLGLIAF

SEQ ID NO: 4737 - protein, 9 aa, Homo sapiens
SSHARLSAY

SEQ ID NO: 4738 - protein, 9 aa, Homo sapiens
SSHARLSAY

SEQ ID NO: 4739 - protein, 9 aa, Homo sapiens
ARLSAYATL

SEQ ID NO: 4740 - protein, 9 aa, Homo sapiens
LPDEASGAF

SEQ ID NO: 4741 - protein, 9 aa, Homo sapiens
LPDEASGAF

SEQ ID NO: 4742 - protein, 9 aa, Homo sapiens
RLRSLTTQI

SEQ ID NO: 4743 - protein, 9 aa, Homo sapiens
KIYIRLKSR

SEQ ID NO: 4744 - protein, 9 aa, Homo sapiens
KSRNNMMDK

SEQ ID NO: 4745 - protein, 9 aa, Homo sapiens
KIYIRLKMR

SEQ ID NO: 4746 - protein, 9 aa, Homo sapiens
KMRNNMMDK

SEQ ID NO: 4747 - protein, 9 aa, Homo sapiens
HIFNLTKNK

SEQ ID NO: 4748 - protein, 9 aa, Homo sapiens
LAHSPLHIF

SEQ ID NO: 4749 - protein, 9 aa, Homo sapiens
PPRWWSGEW

SEQ ID NO: 4750 - protein, 9 aa, Homo sapiens
CPSEDVVVT

SEQ ID NO: 4751 - protein, 9 aa, Homo sapiens
VPFLCPGQM

SEQ ID NO: 4752 - protein, 9 aa, Homo sapiens
VPFLCPGQM

SEQ ID NO: 4753 - protein, 9 aa, Homo sapiens
AMADSDHLM

SEQ ID NO: 4754 - protein, 9 aa, Homo sapiens
FRCLFLPSY

SEQ ID NO: 4755 - protein, 9 aa, Homo sapiens
FLPSYVGAL

SEQ ID NO: 4756 - protein, 9 aa, Homo sapiens
TRNDKTKAL

SEQ ID NO: 4757 - protein, 9 aa, Homo sapiens
IGLIFSLSK

SEQ ID NO: 4758 - protein, 9 aa, Homo sapiens
RSSSPGKPL

SEQ ID NO: 4759 - protein, 9 aa, Homo sapiens
AVRLCRRSK

SEQ ID NO: 4760 - protein, 9 aa, Homo sapiens
LPLLDDSKF

SEQ ID NO: 4761 - protein, 9 aa, Homo sapiens
SWDWAKSSF

SEQ ID NO: 4762 - protein, 9 aa, Homo sapiens
PPADTNQTL

SEQ ID NO: 4763 - protein, 9 aa, Homo sapiens
QPPAKTFLY

SEQ ID NO: 4764 - protein, 9 aa, Homo sapiens
KAFGTSSSH

SEQ ID NO: 4765 - protein, 9 aa, Homo sapiens
FALELQKAF

SEQ ID NO: 4766 - protein, 9 aa, Homo sapiens
MQALSLWQK

SEQ ID NO: 4767 - protein, 9 aa, Homo sapiens
LALEHLHSL

SEQ ID NO: 4768 - protein, 9 aa, Homo sapiens
FADSAILLL

SEQ ID NO: 4769 - protein, 9 aa, Homo sapiens
HRFADSAIL

SEQ ID NO: 4770 - protein, 9 aa, Homo sapiens
LPDQSSPVS

SEQ ID NO: 4771 - protein, 9 aa, Homo sapiens
HPVITTPSA

SEQ ID NO: 4772 - protein, 9 aa, Homo sapiens
HPVITTPSA

SEQ ID NO: 4773 - protein, 9 aa, Homo sapiens
AVRPALNVV

SEQ ID NO: 4774 - protein, 9 aa, Homo sapiens
SFQAVRPAL

SEQ ID NO: 4775 - protein, 9 aa, Homo sapiens
LSYAISVWR

SEQ ID NO: 4776 - protein, 9 aa, Homo sapiens
SYAISVWRM

SEQ ID NO: 4777 - protein, 9 aa, Homo sapiens
VLNGTFSLK

SEQ ID NO: 4778 - protein, 9 aa, Homo sapiens
RVFLLTVPF

SEQ ID NO: 4779 - protein, 9 aa, Homo sapiens
CLNGRFSEK

SEQ ID NO: 4780 - protein, 9 aa, Homo sapiens
NAVCLNGRF

SEQ ID NO: 4781 - protein, 9 aa, Homo sapiens
YLLLFASIK

SEQ ID NO: 4782 - protein, 9 aa, Homo sapiens
DPYLRSWEM

SEQ ID NO: 4783 - protein, 9 aa, Homo sapiens
YLRSWEMYL

SEQ ID NO: 4784 - protein, 9 aa, Homo sapiens
NPQGSSWEH

SEQ ID NO: 4785 - protein, 9 aa, Homo sapiens
LVGAAIFRK

SEQ ID NO: 4786 - protein, 9 aa, Homo sapiens
VSRLDGSSL

SEQ ID NO: 4787 - protein, 9 aa, Homo sapiens
TIVMYMAPK

SEQ ID NO: 4788 - protein, 9 aa, Homo sapiens
LFFGSTIVM

SEQ ID NO: 4789 - protein, 9 aa, Homo sapiens
FFGSTIVMY

SEQ ID NO: 4790 - protein, 9 aa, Homo sapiens
WASIIVKNY

SEQ ID NO: 4791 - protein, 9 aa, Homo sapiens
RLTNTFCAR

SEQ ID NO: 4792 - protein, 9 aa, Homo sapiens
LYTLRIVSL

SEQ ID NO: 4793 - protein, 9 aa, Homo sapiens
LPIGYGGHI

SEQ ID NO: 4794 - protein, 9 aa, Homo sapiens
RSSIGFLIY

SEQ ID NO: 4795 - protein, 9 aa, Homo sapiens
RSSIGFLIY

SEQ ID NO: 4796 - protein, 9 aa, Homo sapiens
KSLAQINSK

SEQ ID NO: 4797 - protein, 9 aa, Homo sapiens
SRKDSGSSL

SEQ ID NO: 4798 - protein, 9 aa, Homo sapiens
TLKSQKKHK

SEQ ID NO: 4799 - protein, 9 aa, Homo sapiens
TSWDMAELY

SEQ ID NO: 4800 - protein, 9 aa, Homo sapiens
TSWDMAELY

SEQ ID NO: 4801 - protein, 9 aa, Homo sapiens
WDMAELYPF

SEQ ID NO: 4802 - protein, 9 aa, Homo sapiens
TVKDFSLAK

SEQ ID NO: 4803 - protein, 9 aa, Homo sapiens
NLNYRDLYY

SEQ ID NO: 4804 - protein, 9 aa, Homo sapiens
VSYPDNLNY

SEQ ID NO: 4805 - protein, 9 aa, Homo sapiens
VSYPDNLNY

SEQ ID NO: 4806 - protein, 9 aa, Homo sapiens
NYRDLYYFL

SEQ ID NO: 4807 - protein, 9 aa, Homo sapiens
AVLGLPSSL

SEQ ID NO: 4808 - protein, 9 aa, Homo sapiens
LPSSLASSV

SEQ ID NO: 4809 - protein, 9 aa, Homo sapiens
VPAVLGLPS

SEQ ID NO: 4810 - protein, 9 aa, Homo sapiens
LPSSLASSV

SEQ ID NO: 4811 - protein, 9 aa, Homo sapiens
LPTATVPPM

SEQ ID NO: 4812 - protein, 9 aa, Homo sapiens
LPTATVPPM

SEQ ID NO: 4813 - protein, 9 aa, Homo sapiens
RADGAPRSM

SEQ ID NO: 4814 - protein, 9 aa, Homo sapiens
APRSMVPAW

SEQ ID NO: 4815 - protein, 9 aa, Homo sapiens
FLFLLCVIM

SEQ ID NO: 4816 - protein, 9 aa, Homo sapiens
SLLIKKGMK

SEQ ID NO: 4817 - protein, 9 aa, Homo sapiens
ELVGYTLVY

SEQ ID NO: 4818 - protein, 9 aa, Homo sapiens
YYKYSHQVF

SEQ ID NO: 4819 - protein, 9 aa, Homo sapiens
YKYSHQVFF

SEQ ID NO: 4820 - protein, 9 aa, Homo sapiens
SYQSFIGNL

SEQ ID NO: 4821 - protein, 9 aa, Homo sapiens
KPLSGLTPL

SEQ ID NO: 4822 - protein, 9 aa, Homo sapiens
KPLSGLTPL

SEQ ID NO: 4823 - protein, 9 aa, Homo sapiens
SPERTQSTF

SEQ ID NO: 4824 - protein, 9 aa, Homo sapiens
SPERTQSTF

SEQ ID NO: 4825 - protein, 9 aa, Homo sapiens
LPTTMNYPI

SEQ ID NO: 4826 - protein, 9 aa, Homo sapiens
LPTTMNYPI

SEQ ID NO: 4827 - protein, 9 aa, Homo sapiens
YTSLIVSCK

SEQ ID NO: 4828 - protein, 9 aa, Homo sapiens
AEPGSLLAW

SEQ ID NO: 4829 - protein, 9 aa, Homo sapiens
RLKIQPVEK

SEQ ID NO: 4830 - protein, 9 aa, Homo sapiens
SLSIKGASK

SEQ ID NO: 4831 - protein, 9 aa, Homo sapiens
KQRVMVMLY

SEQ ID NO: 4832 - protein, 9 aa, Homo sapiens
RVMVMLYNK

SEQ ID NO: 4833 - protein, 9 aa, Homo sapiens
EEWVQHLKF

SEQ ID NO: 4834 - protein, 9 aa, Homo sapiens
QTIRIHSLK

SEQ ID NO: 4835 - protein, 9 aa, Homo sapiens
RIHSLKSGK

SEQ ID NO: 4836 - protein, 9 aa, Homo sapiens
SLKSGKTLK

SEQ ID NO: 4837 - protein, 9 aa, Homo sapiens
ELVHRPALK

SEQ ID NO: 4838 - protein, 9 aa, Homo sapiens
KRTALSKLV

SEQ ID NO: 4839 - protein, 9 aa, Homo sapiens
DTSYVLTPY

SEQ ID NO: 4840 - protein, 9 aa, Homo sapiens
LHRAGGSSL

SEQ ID NO: 4841 - protein, 9 aa, Homo sapiens
KSFSKYVSF

SEQ ID NO: 4842 - protein, 9 aa, Homo sapiens
VSFSNHQRV

SEQ ID NO: 4843 - protein, 9 aa, Homo sapiens
GWLDNANSF

SEQ ID NO: 4844 - protein, 9 aa, Homo sapiens
YAFPKQFPY

SEQ ID NO: 4845 - protein, 9 aa, Homo sapiens
AEIKNSPKI

SEQ ID NO: 4846 - protein, 9 aa, Homo sapiens
RVLQIGSAK

SEQ ID NO: 4847 - protein, 9 aa, Homo sapiens
TYTVATPLL

SEQ ID NO: 4848 - protein, 9 aa, Homo sapiens
RYAAIRHPL

SEQ ID NO: 4849 - protein, 9 aa, Homo sapiens
AAIRHPLHY

SEQ ID NO: 4850 - protein, 9 aa, Homo sapiens
IPGLKDTQY

SEQ ID NO: 4851 - protein, 9 aa, Homo sapiens
LSGPFCVMY

SEQ ID NO: 4852 - protein, 9 aa, Homo sapiens
TPTDNANSF

SEQ ID NO: 4853 - protein, 9 aa, Homo sapiens
KFMAVFYTI

SEQ ID NO: 4854 - protein, 9 aa, Homo sapiens
FPTDKFMAV

SEQ ID NO: 4855 - protein, 9 aa, Homo sapiens
MAVFYTIIT

SEQ ID NO: 4856 - protein, 9 aa, Homo sapiens
EPDQLAQRM

SEQ ID NO: 4857 - protein, 9 aa, Homo sapiens
MAQEAALVA

SEQ ID NO: 4858 - protein, 9 aa, Homo sapiens
QQFFNGHPF

SEQ ID NO: 4859 - protein, 9 aa, Homo sapiens
ILASAVGSY

SEQ ID NO: 4860 - protein, 9 aa, Homo sapiens
FPILASAVG

SEQ ID NO: 4861 - protein, 9 aa, Homo sapiens
ILASAVGSY

SEQ ID NO: 4862 - protein, 9 aa, Homo sapiens
RTHCVTNKK

SEQ ID NO: 4863 - protein, 9 aa, Homo sapiens
IIYFHQYTH

SEQ ID NO: 4864 - protein, 9 aa, Homo sapiens
FLLLCTIIY

SEQ ID NO: 4865 - protein, 9 aa, Homo sapiens
KLVAETAGK

SEQ ID NO: 4866 - protein, 9 aa, Homo sapiens
RVALGDVLK

SEQ ID NO: 4867 - protein, 9 aa, Homo sapiens
TAALRIGAY

SEQ ID NO: 4868 - protein, 9 aa, Homo sapiens
VVAASGVEK

SEQ ID NO: 4869 - protein, 9 aa, Homo sapiens
SSALQTLEK

SEQ ID NO: 4870 - protein, 9 aa, Homo sapiens
VYSSALQTL

SEQ ID NO: 4871 - protein, 9 aa, Homo sapiens
SALQTLEKY

SEQ ID NO: 4872 - protein, 9 aa, Homo sapiens
RMKTCLLIR

SEQ ID NO: 4873 - protein, 9 aa, Homo sapiens
FALWLNDCH

SEQ ID NO: 4874 - protein, 9 aa, Homo sapiens
WLNDCHEKY

SEQ ID NO: 4875 - protein, 9 aa, Homo sapiens
NAHGEENGF

SEQ ID NO: 4876 - protein, 9 aa, Homo sapiens
QQYTGPAAY

SEQ ID NO: 4877 - protein, 9 aa, Homo sapiens
CVWVPRLAF

SEQ ID NO: 4878 - protein, 9 aa, Homo sapiens
VPRLAFVLF

SEQ ID NO: 4879 - protein, 9 aa, Homo sapiens
RTHRSLSKH

SEQ ID NO: 4880 - protein, 9 aa, Homo sapiens
GPEKRNVAY

SEQ ID NO: 4881 - protein, 9 aa, Homo sapiens
CTNEVSDMM

SEQ ID NO: 4882 - protein, 9 aa, Homo sapiens
LAMKKPMAK

SEQ ID NO: 4883 - protein, 9 aa, Homo sapiens
CVNKEELAM

SEQ ID NO: 4884 - protein, 9 aa, Homo sapiens
AWAMSISIF

SEQ ID NO: 4885 - protein, 9 aa, Homo sapiens
YGASLAWAM

SEQ ID NO: 4886 - protein, 9 aa, Homo sapiens
LAWAMSISI

SEQ ID NO: 4887 - protein, 9 aa, Homo sapiens
VPEQAEYAT

SEQ ID NO: 4888 - protein, 9 aa, Homo sapiens
QAEYATIVF

SEQ ID NO: 4889 - protein, 9 aa, Homo sapiens
TSYSWWARL

SEQ ID NO: 4890 - protein, 9 aa, Homo sapiens
NSSYLSSVM

SEQ ID NO: 4891 - protein, 9 aa, Homo sapiens
SPSSVSTGH

SEQ ID NO: 4892 - protein, 9 aa, Homo sapiens
NPNACGSVS

SEQ ID NO: 4893 - protein, 9 aa, Homo sapiens
NACGSVSCY

SEQ ID NO: 4894 - protein, 9 aa, Homo sapiens
PLSTYSLKK

SEQ ID NO: 4895 - protein, 9 aa, Homo sapiens
TTTGHLICK

SEQ ID NO: 4896 - protein, 9 aa, Homo sapiens
SSVQKLVPY

SEQ ID NO: 4897 - protein, 9 aa, Homo sapiens
VPYETRARY

SEQ ID NO: 4898 - protein, 9 aa, Homo sapiens
SVCMLSGSK

SEQ ID NO: 4899 - protein, 9 aa, Homo sapiens
CMLSGSKEK

SEQ ID NO: 4900 - protein, 9 aa, Homo sapiens
QLRLIFAGK

SEQ ID NO: 4901 - protein, 9 aa, Homo sapiens
CPVDGSLSN

SEQ ID NO: 4902 - protein, 9 aa, Homo sapiens
EVACSPCEM

SEQ ID NO: 4903 - protein, 9 aa, Homo sapiens
ILRITNNGK

SEQ ID NO: 4904 - protein, 9 aa, Homo sapiens
QLLRRTCAR

SEQ ID NO: 4905 - protein, 9 aa, Homo sapiens
ISQAAVPAM

SEQ ID NO: 4906 - protein, 9 aa, Homo sapiens
TLGHLPVIK

SEQ ID NO: 4907 - protein, 9 aa, Homo sapiens
HRMERMVQM

SEQ ID NO: 4908 - protein, 9 aa, Homo sapiens
ERMVQMYTL

SEQ ID NO: 4909 - protein, 9 aa, Homo sapiens
AHRMERMEL

SEQ ID NO: 4910 - protein, 9 aa, Homo sapiens
HRMERMELM

SEQ ID NO: 4911 - protein, 9 aa, Homo sapiens
ERMELMYTL

SEQ ID NO: 4912 - protein, 9 aa, Homo sapiens
VLDNFKRFK

SEQ ID NO: 4913 - protein, 9 aa, Homo sapiens
KLALLEDAR

SEQ ID NO: 4914 - protein, 9 aa, Homo sapiens
APNRDQWCM

SEQ ID NO: 4915 - protein, 9 aa, Homo sapiens
DQWCMTPPM

SEQ ID NO: 4916 - protein, 9 aa, Homo sapiens
VVIRQERAR

SEQ ID NO: 4917 - protein, 9 aa, Homo sapiens
IRQERARQT

SEQ ID NO: 4918 - protein, 9 aa, Homo sapiens
ARQTSVSLL

SEQ ID NO: 4919 - protein, 9 aa, Homo sapiens
QPYGWSPSA

SEQ ID NO: 4920 - protein, 9 aa, Homo sapiens
FPQGYGFGL

SEQ ID NO: 4921 - protein, 9 aa, Homo sapiens
RALREVYIR

SEQ ID NO: 4922 - protein, 9 aa, Homo sapiens
IRALREVYI

SEQ ID NO: 4923 - protein, 9 aa, Homo sapiens
FIASAMAVK

SEQ ID NO: 4924 - protein, 9 aa, Homo sapiens
IASAMAVKR

SEQ ID NO: 4925 - protein, 9 aa, Homo sapiens
AVKRALAIR

SEQ ID NO: 4926 - protein, 9 aa, Homo sapiens
MAVKRALAI

SEQ ID NO: 4927 - protein, 9 aa, Homo sapiens
MPNASVDVG

SEQ ID NO: 4928 - protein, 9 aa, Homo sapiens
IVMEFILTH

SEQ ID NO: 4929 - protein, 9 aa, Homo sapiens
KQTSPEEIR

SEQ ID NO: 4930 - protein, 9 aa, Homo sapiens
PASCATSNY

SEQ ID NO: 4931 - protein, 9 aa, Homo sapiens
MACNGSSSF

SEQ ID NO: 4932 - protein, 9 aa, Homo sapiens
MACHSSSSF

SEQ ID NO: 4933 - protein, 9 aa, Homo sapiens
PVMRLFGYK

SEQ ID NO: 4934 - protein, 9 aa, Homo sapiens
PVMRLFGYK

SEQ ID NO: 4935 - protein, 9 aa, Homo sapiens
GPVMRLFGY

SEQ ID NO: 4936 - protein, 9 aa, Homo sapiens
QSANESKNK

SEQ ID NO: 4937 - protein, 9 aa, Homo sapiens
LEKSRIHLR

SEQ ID NO: 4938 - protein, 9 aa, Homo sapiens
RIHLRRTLR

SEQ ID NO: 4939 - protein, 9 aa, Homo sapiens
SRIHLRRTL

SEQ ID NO: 4940 - protein, 9 aa, Homo sapiens
LRGPPPSSV

SEQ ID NO: 4941 - protein, 9 aa, Homo sapiens
RTPAEQVPR

SEQ ID NO: 4942 - protein, 9 aa, Homo sapiens
PVYTRQASK

SEQ ID NO: 4943 - protein, 9 aa, Homo sapiens
TELNTFYLK

SEQ ID NO: 4944 - protein, 9 aa, Homo sapiens
LLTELNTFY

SEQ ID NO: 4945 - protein, 9 aa, Homo sapiens
TPAATSFTA

SEQ ID NO: 4946 - protein, 9 aa, Homo sapiens
TPRATSFTA

SEQ ID NO: 4947 - protein, 9 aa, Homo sapiens
TPTATGFTA

SEQ ID NO: 4948 - protein, 9 aa, Homo sapiens
TPTATIFTA

SEQ ID NO: 4949 - protein, 9 aa, Homo sapiens
TATTPTATR

SEQ ID NO: 4950 - protein, 9 aa, Homo sapiens
TPTATRFTA

SEQ ID NO: 4951 - protein, 9 aa, Homo sapiens
TPTATSSTA

SEQ ID NO: 4952 - protein, 9 aa, Homo sapiens
TPTATSFAA

SEQ ID NO: 4953 - protein, 9 aa, Homo sapiens
FAAIPSSSL

SEQ ID NO: 4954 - protein, 9 aa, Homo sapiens
TATTPTATR

SEQ ID NO: 4955 - protein, 9 aa, Homo sapiens
TPTATRFTA

SEQ ID NO: 4956 - protein, 9 aa, Homo sapiens
TPTATSSTA

SEQ ID NO: 4957 - protein, 9 aa, Homo sapiens
SVFLAPAFH

SEQ ID NO: 4958 - protein, 9 aa, Homo sapiens
DSVFLAPAF

SEQ ID NO: 4959 - protein, 9 aa, Homo sapiens
CSRGRPRFL

SEQ ID NO: 4960 - protein, 9 aa, Homo sapiens
MGVAGMSPF

SEQ ID NO: 4961 - protein, 9 aa, Homo sapiens
LPSSRPSQL

SEQ ID NO: 4962 - protein, 9 aa, Homo sapiens
RLRRRPANR

SEQ ID NO: 4963 - protein, 9 aa, Homo sapiens
ESFLFKINK

SEQ ID NO: 4964 - protein, 9 aa, Homo sapiens
LFKINKSYR

SEQ ID NO: 4965 - protein, 9 aa, Homo sapiens
FLFKINKSY

SEQ ID NO: 4966 - protein, 9 aa, Homo sapiens
SRVEIVNGV

SEQ ID NO: 4967 - protein, 9 aa, Homo sapiens
KFFLCQVAR

SEQ ID NO: 4968 - protein, 9 aa, Homo sapiens
STCGKQLKR

SEQ ID NO: 4969 - protein, 9 aa, Homo sapiens
STCGKQLKR

SEQ ID NO: 4970 - protein, 9 aa, Homo sapiens
QLKRKDKLR

SEQ ID NO: 4971 - protein, 9 aa, Homo sapiens
GTKGEFFAK

SEQ ID NO: 4972 - protein, 9 aa, Homo sapiens
GTKGEFFAK

SEQ ID NO: 4973 - protein, 9 aa, Homo sapiens
KLMNEPALR

SEQ ID NO: 4974 - protein, 9 aa, Homo sapiens
KLMNEPALR

SEQ ID NO: 4975 - protein, 9 aa, Homo sapiens
SPVTLETSL

SEQ ID NO: 4976 - protein, 9 aa, Homo sapiens
LRGPLSRLL

SEQ ID NO: 4977 - protein, 9 aa, Homo sapiens
HPYEGEPPS

SEQ ID NO: 4978 - protein, 9 aa, Homo sapiens
HWYSWLLYR

SEQ ID NO: 4979 - protein, 9 aa, Homo sapiens
MHWYSWLLY

SEQ ID NO: 4980 - protein, 9 aa, Homo sapiens
AVPLRWGPR

SEQ ID NO: 4981 - protein, 9 aa, Homo sapiens
IANVAHTFM

SEQ ID NO: 4982 - protein, 9 aa, Homo sapiens
VHVAQGTQV

SEQ ID NO: 4983 - protein, 9 aa, Homo sapiens
SLCLSLCLR

SEQ ID NO: 4984 - protein, 9 aa, Homo sapiens
SLCLSLCLR

SEQ ID NO: 4985 - protein, 9 aa, Homo sapiens
YQLTPSFEY

SEQ ID NO: 4986 - protein, 9 aa, Homo sapiens
FHQEMLNYQ

SEQ ID NO: 4987 - protein, 9 aa, Homo sapiens
ATCRQWLEK

SEQ ID NO: 4988 - protein, 9 aa, Homo sapiens
SQRYIAQLK

SEQ ID NO: 4989 - protein, 9 aa, Homo sapiens
ASIWNTFTH

SEQ ID NO: 4990 - protein, 9 aa, Homo sapiens
SIWNTFTHH

SEQ ID NO: 4991 - protein, 9 aa, Homo sapiens
APFLVPIEL

SEQ ID NO: 4992 - protein, 9 aa, Homo sapiens
NRDSSASLL

SEQ ID NO: 4993 - protein, 9 aa, Homo sapiens
HCWDYRRFL

SEQ ID NO: 4994 - protein, 9 aa, Homo sapiens
MSSANVYLK

SEQ ID NO: 4995 - protein, 9 aa, Homo sapiens
SANVYLKSK

SEQ ID NO: 4996 - protein, 9 aa, Homo sapiens
MSSANVYLK

SEQ ID NO: 4997 - protein, 9 aa, Homo sapiens
TPDLSHHLY

SEQ ID NO: 4998 - protein, 9 aa, Homo sapiens
CPAQTLRVL

SEQ ID NO: 4999 - protein, 9 aa, Homo sapiens
RGPEWSATR

SEQ ID NO: 5000 - protein, 9 aa, Homo sapiens
WSATRRASR

SEQ ID NO: 5001 - protein, 9 aa, Homo sapiens
TRRASREAV

SEQ ID NO: 5002 - protein, 9 aa, Homo sapiens
YKRMRRQSV

SEQ ID NO: 5003 - protein, 9 aa, Homo sapiens
MRRQSVGDF

SEQ ID NO: 5004 - protein, 9 aa, Homo sapiens
TEMEHELLL

SEQ ID NO: 5005 - protein, 9 aa, Homo sapiens
RICPPWFYG

SEQ ID NO: 5006 - protein, 9 aa, Homo sapiens
MDERWYTPR

SEQ ID NO: 5007 - protein, 9 aa, Homo sapiens
NATMDERWY

SEQ ID NO: 5008 - protein, 9 aa, Homo sapiens
GTDPCPTWK

SEQ ID NO: 5009 - protein, 9 aa, Homo sapiens
HTFRARITY

SEQ ID NO: 5010 - protein, 9 aa, Homo sapiens
FRNRPHTFR

SEQ ID NO: 5011 - protein, 9 aa, Homo sapiens
HTFRARITY

SEQ ID NO: 5012 - protein, 9 aa, Homo sapiens
RLQELERLR

SEQ ID NO: 5013 - protein, 9 aa, Homo sapiens
VYEQFLAPR

SEQ ID NO: 5014 - protein, 9 aa, Homo sapiens
SGAVYSTVK

SEQ ID NO: 5015 - protein, 9 aa, Homo sapiens
KTESMFMAR

SEQ ID NO: 5016 - protein, 9 aa, Homo sapiens
KTESMFMAR

SEQ ID NO: 5017 - protein, 9 aa, Homo sapiens
FRGNSYPGV

SEQ ID NO: 5018 - protein, 9 aa, Homo sapiens
LLWFCVMSR

SEQ ID NO: 5019 - protein, 9 aa, Homo sapiens
LLWFCVMSR

SEQ ID NO: 5020 - protein, 9 aa, Homo sapiens
KGKGLTTAR

SEQ ID NO: 5021 - protein, 9 aa, Homo sapiens
LTTARGGNR

SEQ ID NO: 5022 - protein, 9 aa, Homo sapiens
TTARGGNRR

SEQ ID NO: 5023 - protein, 9 aa, Homo sapiens
YPAYAGDGG

SEQ ID NO: 5024 - protein, 9 aa, Homo sapiens
YAGDGGFVL

SEQ ID NO: 5025 - protein, 9 aa, Homo sapiens
TAGAPDPAL

SEQ ID NO: 5026 - protein, 9 aa, Homo sapiens
ASLDPTPGR

SEQ ID NO: 5027 - protein, 9 aa, Homo sapiens
ASLDPTPGR

SEQ ID NO: 5028 - protein, 9 aa, Homo sapiens
SSEASETCK

SEQ ID NO: 5029 - protein, 9 aa, Homo sapiens
IAMASSDPA

SEQ ID NO: 5030 - protein, 9 aa, Homo sapiens
MASSDPAAA

SEQ ID NO: 5031 - protein, 9 aa, Homo sapiens
EPASEPAPS

SEQ ID NO: 5032 - protein, 9 aa, Homo sapiens
EPISEPAPS

SEQ ID NO: 5033 - protein, 9 aa, Homo sapiens
SYWPTSPSY

SEQ ID NO: 5034 - protein, 9 aa, Homo sapiens
KSSGAVPSR

SEQ ID NO: 5035 - protein, 9 aa, Homo sapiens
KSSGAVPSR

SEQ ID NO: 5036 - protein, 9 aa, Homo sapiens
DVNEDDSEL

SEQ ID NO: 5037 - protein, 9 aa, Homo sapiens
FNYYTMSAM

SEQ ID NO: 5038 - protein, 9 aa, Homo sapiens
YFQVLIDAR

SEQ ID NO: 5039 - protein, 9 aa, Homo sapiens
EVSGKGPAM

SEQ ID NO: 5040 - protein, 9 aa, Homo sapiens
WFRSVTHAY

SEQ ID NO: 5041 - protein, 9 aa, Homo sapiens
LPFADEGNL

SEQ ID NO: 5042 - protein, 9 aa, Homo sapiens
FADEGNLTI

SEQ ID NO: 5043 - protein, 9 aa, Homo sapiens
RSSLCPNVK

SEQ ID NO: 5044 - protein, 9 aa, Homo sapiens
YRSSLCPNV

SEQ ID NO: 5045 - protein, 9 aa, Homo sapiens
RRNAKEEQV

SEQ ID NO: 5046 - protein, 9 aa, Homo sapiens
GSCSRDHDR

SEQ ID NO: 5047 - protein, 9 aa, Homo sapiens
GPASLWAEY

SEQ ID NO: 5048 - protein, 9 aa, Homo sapiens
VLNSLVEEK

SEQ ID NO: 5049 - protein, 9 aa, Homo sapiens
PQIPILHFR

SEQ ID NO: 5050 - protein, 9 aa, Homo sapiens
VTSRRNQEL

SEQ ID NO: 5051 - protein, 9 aa, Homo sapiens
SRRNQELAF

SEQ ID NO: 5052 - protein, 9 aa, Homo sapiens
LVQYYDDKK

SEQ ID NO: 5053 - protein, 9 aa, Homo sapiens
RLLSPECWK

SEQ ID NO: 5054 - protein, 9 aa, Homo sapiens
LLMQSSAER

SEQ ID NO: 5055 - protein, 9 aa, Homo sapiens
RLLSPECWK

SEQ ID NO: 5056 - protein, 9 aa, Homo sapiens
MQSSAERLL

SEQ ID NO: 5057 - protein, 9 aa, Homo sapiens
QPQQLAPEF

SEQ ID NO: 5058 - protein, 9 aa, Homo sapiens
LAPEFPLAH

SEQ ID NO: 5059 - protein, 9 aa, Homo sapiens
KLPFYFDPK

SEQ ID NO: 5060 - protein, 9 aa, Homo sapiens
FYFDPKRAV

SEQ ID NO: 5061 - protein, 9 aa, Homo sapiens
SPVQVPSPV

SEQ ID NO: 5062 - protein, 9 aa, Homo sapiens
SPVAASTEA

SEQ ID NO: 5063 - protein, 9 aa, Homo sapiens
LPALAPGSL

SEQ ID NO: 5064 - protein, 9 aa, Homo sapiens
VWTAIGEAR

SEQ ID NO: 5065 - protein, 9 aa, Homo sapiens
FVVEVWTAI

SEQ ID NO: 5066 - protein, 9 aa, Homo sapiens
ATLSKDPHR

SEQ ID NO: 5067 - protein, 9 aa, Homo sapiens
STGLTGAAK

SEQ ID NO: 5068 - protein, 9 aa, Homo sapiens
LTGAAKLAK

SEQ ID NO: 5069 - protein, 9 aa, Homo sapiens
STGVTGAVK

SEQ ID NO: 5070 - protein, 9 aa, Homo sapiens
VTGAVKLAK

SEQ ID NO: 5071 - protein, 9 aa, Homo sapiens
SSGLTGAVK

SEQ ID NO: 5072 - protein, 9 aa, Homo sapiens
YSPNRNEAL

SEQ ID NO: 5073 - protein, 9 aa, Homo sapiens
VSHMTSDHR

SEQ ID NO: 5074 - protein, 9 aa, Homo sapiens
MTSDHRQWC

SEQ ID NO: 5075 - protein, 9 aa, Homo sapiens
RYINRMTNE

SEQ ID NO: 5076 - protein, 9 aa, Homo sapiens
TSGRSYHLR

SEQ ID NO: 5077 - protein, 9 aa, Homo sapiens
TSGRSYHLR

SEQ ID NO: 5078 - protein, 9 aa, Homo sapiens
RSYHLRHKV

SEQ ID NO: 5079 - protein, 9 aa, Homo sapiens
HQQKPIESR

SEQ ID NO: 5080 - protein, 9 aa, Homo sapiens
QQKPIESRR

SEQ ID NO: 5081 - protein, 9 aa, Homo sapiens
YSSTLIAHK

SEQ ID NO: 5082 - protein, 9 aa, Homo sapiens
SSTLIAHKR

SEQ ID NO: 5083 - protein, 9 aa, Homo sapiens
SSTLIAHKR

SEQ ID NO: 5084 - protein, 9 aa, Homo sapiens
IIHTGEKPY

SEQ ID NO: 5085 - protein, 9 aa, Homo sapiens
CSSNLTKHK

SEQ ID NO: 5086 - protein, 9 aa, Homo sapiens
SSNLTKHKK

SEQ ID NO: 5087 - protein, 9 aa, Homo sapiens
SSNLTKHKK

SEQ ID NO: 5088 - protein, 9 aa, Homo sapiens
ITRSGVRDR

SEQ ID NO: 5089 - protein, 9 aa, Homo sapiens
RSSHLTQHK

SEQ ID NO: 5090 - protein, 9 aa, Homo sapiens
SSHLTQHKR

SEQ ID NO: 5091 - protein, 9 aa, Homo sapiens
RSSHLTQHK

SEQ ID NO: 5092 - protein, 9 aa, Homo sapiens
SSHLTQHKR

SEQ ID NO: 5093 - protein, 9 aa, Homo sapiens
TQHKRIHTR

SEQ ID NO: 5094 - protein, 9 aa, Homo sapiens
GSSNLNAHK

SEQ ID NO: 5095 - protein, 9 aa, Homo sapiens
GSSNLNAHK

SEQ ID NO: 5096 - protein, 9 aa, Homo sapiens
GSSNFTAHK

SEQ ID NO: 5097 - protein, 9 aa, Homo sapiens
GSSNFTAHK

SEQ ID NO: 5098 - protein, 9 aa, Homo sapiens
GSSNFNEHK

SEQ ID NO: 5099 - protein, 9 aa, Homo sapiens
IIHTAEKPY

SEQ ID NO: 5100 - protein, 9 aa, Homo sapiens
EVCGKAFSR

SEQ ID NO: 5101 - protein, 9 aa, Homo sapiens
EYGKSFTFR

SEQ ID NO: 5102 - protein, 9 aa, Homo sapiens
KLKKTKLPK

SEQ ID NO: 5103 - protein, 9 aa, Homo sapiens
KLKKTKLPK

SEQ ID NO: 5104 - protein, 9 aa, Homo sapiens
DIFEINLSK

SEQ ID NO: 5105 - protein, 9 aa, Homo sapiens
RMEDAHCTR

SEQ ID NO: 5106 - protein, 9 aa, Homo sapiens
MEDAHCTRL

SEQ ID NO: 5107 - protein, 9 aa, Homo sapiens
AASGVLAAM

SEQ ID NO: 5108 - protein, 9 aa, Homo sapiens
MAAGANPAA

SEQ ID NO: 5109 - protein, 9 aa, Homo sapiens
VPIQEGHSL

SEQ ID NO: 5110 - protein, 9 aa, Homo sapiens
RNLHLVRHR

SEQ ID NO: 5111 - protein, 9 aa, Homo sapiens
RFCTKPFRR

SEQ ID NO: 5112 - protein, 9 aa, Homo sapiens
ALFTRIKLL

SEQ ID NO: 5113 - protein, 9 aa, Homo sapiens
ASIPETRAK

SEQ ID NO: 5114 - protein, 9 aa, Homo sapiens
FKIENTGQL

SEQ ID NO: 5115 - protein, 9 aa, Homo sapiens
PTSDLLFQK

SEQ ID NO: 5116 - protein, 9 aa, Homo sapiens
LLFQKLHSR

SEQ ID NO: 5117 - protein, 9 aa, Homo sapiens
FQKLHSRLL

SEQ ID NO: 5118 - protein, 9 aa, Homo sapiens
VAHEMGLGK

SEQ ID NO: 5119 - protein, 9 aa, Homo sapiens
APAASEEIF

SEQ ID NO: 5120 - protein, 9 aa, Homo sapiens
LPAPRPPAY

SEQ ID NO: 5121 - protein, 9 aa, Homo sapiens
AAHSVRPER

SEQ ID NO: 5122 - protein, 9 aa, Homo sapiens
SRRTRCEDM

SEQ ID NO: 5123 - protein, 9 aa, Homo sapiens
TRCEDMDEL

SEQ ID NO: 5124 - protein, 9 aa, Homo sapiens
TVNSNCLDK

SEQ ID NO: 5125 - protein, 9 aa, Homo sapiens
LACWEDTPL

SEQ ID NO: 5126 - protein, 9 aa, Homo sapiens
AVNPVLYLL

SEQ ID NO: 5127 - protein, 9 aa, Homo sapiens
YLLCHHSFR

SEQ ID NO: 5128 - protein, 9 aa, Homo sapiens
LLCHHSFRR

SEQ ID NO: 5129 - protein, 9 aa, Homo sapiens
NPVLYLLCH

SEQ ID NO: 5130 - protein, 9 aa, Homo sapiens
IVSQSFTQR

SEQ ID NO: 5131 - protein, 9 aa, Homo sapiens
IVSQSFTQR

SEQ ID NO: 5132 - protein, 9 aa, Homo sapiens
SRSLSVQHM

SEQ ID NO: 5133 - protein, 9 aa, Homo sapiens
ILRMILMDR

SEQ ID NO: 5134 - protein, 9 aa, Homo sapiens
RTPSGRVCR

SEQ ID NO: 5135 - protein, 9 aa, Homo sapiens
RTPSGHVRR

SEQ ID NO: 5136 - protein, 9 aa, Homo sapiens
RVSFFTLNY

SEQ ID NO: 5137 - protein, 9 aa, Homo sapiens
MNVDFDTPL

SEQ ID NO: 5138 - protein, 9 aa, Homo sapiens
TSVNITWVY

SEQ ID NO: 5139 - protein, 9 aa, Homo sapiens
TSVNITWVY

SEQ ID NO: 5140 - protein, 9 aa, Homo sapiens
YRRDMHQVA

SEQ ID NO: 5141 - protein, 9 aa, Homo sapiens
FGSAADNTL

SEQ ID NO: 5142 - protein, 9 aa, Homo sapiens
SVPGGGAAK

SEQ ID NO: 5143 - protein, 9 aa, Homo sapiens
WRGPEVLDL

SEQ ID NO: 5144 - protein, 9 aa, Homo sapiens
HQEALRFLK

SEQ ID NO: 5145 - protein, 9 aa, Homo sapiens
HQEALRFLK

SEQ ID NO: 5146 - protein, 9 aa, Homo sapiens
RFLKKNSSK

SEQ ID NO: 5147 - protein, 9 aa, Homo sapiens
LTSCLQPLK

SEQ ID NO: 5148 - protein, 9 aa, Homo sapiens
PLKFCCDFR

SEQ ID NO: 5149 - protein, 9 aa, Homo sapiens
QPLKFCCDF

SEQ ID NO: 5150 - protein, 9 aa, Homo sapiens
LSPAHSLAK

SEQ ID NO: 5151 - protein, 9 aa, Homo sapiens
SLAKQPLGK

SEQ ID NO: 5152 - protein, 9 aa, Homo sapiens
PGSWTFHYR

SEQ ID NO: 5153 - protein, 9 aa, Homo sapiens
VPGSWTFHY

SEQ ID NO: 5154 - protein, 9 aa, Homo sapiens
FHYREDPVV

SEQ ID NO: 5155 - protein, 9 aa, Homo sapiens
HYREDPVVL

SEQ ID NO: 5156 - protein, 9 aa, Homo sapiens
YRPQKNPLF

SEQ ID NO: 5157 - protein, 9 aa, Homo sapiens
CLMDEEEMK

SEQ ID NO: 5158 - protein, 9 aa, Homo sapiens
RVCDRSYKR

SEQ ID NO: 5159 - protein, 9 aa, Homo sapiens
VNSHSLFVR

SEQ ID NO: 5160 - protein, 9 aa, Homo sapiens
SLFVRVCDR

SEQ ID NO: 5161 - protein, 9 aa, Homo sapiens
RVCDRSYKR

SEQ ID NO: 5162 - protein, 9 aa, Homo sapiens
FVRVCDRSY

SEQ ID NO: 5163 - protein, 9 aa, Homo sapiens
LVGLTTAAF

SEQ ID NO: 5164 - protein, 9 aa, Homo sapiens
PPILVVLAL

SEQ ID NO: 5165 - protein, 9 aa, Homo sapiens
FCLPSFKSY

SEQ ID NO: 5166 - protein, 9 aa, Homo sapiens
HARPELSER

SEQ ID NO: 5167 - protein, 9 aa, Homo sapiens
VQKICEEER

SEQ ID NO: 5168 - protein, 9 aa, Homo sapiens
FPSDLAELL

SEQ ID NO: 5169 - protein, 9 aa, Homo sapiens
TPLLVTDAS

SEQ ID NO: 5170 - protein, 9 aa, Homo sapiens
LPVTNLSSA

SEQ ID NO: 5171 - protein, 9 aa, Homo sapiens
STGDTTPLY

SEQ ID NO: 5172 - protein, 9 aa, Homo sapiens
TPLYVTDAS

SEQ ID NO: 5173 - protein, 9 aa, Homo sapiens
LPVTSISSA

SEQ ID NO: 5174 - protein, 9 aa, Homo sapiens
TPLPVTSAS

SEQ ID NO: 5175 - protein, 9 aa, Homo sapiens
LPVTSASSV

SEQ ID NO: 5176 - protein, 9 aa, Homo sapiens
GLVYAPIYR

SEQ ID NO: 5177 - protein, 9 aa, Homo sapiens
MGLVYAPIY

SEQ ID NO: 5178 - protein, 9 aa, Homo sapiens
TLTLHTSAK

SEQ ID NO: 5179 - protein, 9 aa, Homo sapiens
LHTSAKVLI

SEQ ID NO: 5180 - protein, 9 aa, Homo sapiens
MLPARLLFR

SEQ ID NO: 5181 - protein, 9 aa, Homo sapiens
LPARLLFRL

SEQ ID NO: 5182 - protein, 9 aa, Homo sapiens
EVYPQSLTK

SEQ ID NO: 5183 - protein, 9 aa, Homo sapiens
RVSLMRPQK

SEQ ID NO: 5184 - protein, 9 aa, Homo sapiens
RVSLMRPQK

SEQ ID NO: 5185 - protein, 9 aa, Homo sapiens
SFVIAVLAK

SEQ ID NO: 5186 - protein, 9 aa, Homo sapiens
LQCVLLLFR

SEQ ID NO: 5187 - protein, 9 aa, Homo sapiens
LQCVLLLFR

SEQ ID NO: 5188 - protein, 9 aa, Homo sapiens
LFMTQQEQR

SEQ ID NO: 5189 - protein, 9 aa, Homo sapiens
TQQEQRRLR

SEQ ID NO: 5190 - protein, 9 aa, Homo sapiens
RLSIQSFPK

SEQ ID NO: 5191 - protein, 9 aa, Homo sapiens
RLSIQSFPK

SEQ ID NO: 5192 - protein, 9 aa, Homo sapiens
FPKCIVGKF

SEQ ID NO: 5193 - protein, 9 aa, Homo sapiens
RPSGCYAPY

SEQ ID NO: 5194 - protein, 9 aa, Homo sapiens
VTQVCHPHR

SEQ ID NO: 5195 - protein, 9 aa, Homo sapiens
VTQVCHPHR

SEQ ID NO: 5196 - protein, 9 aa, Homo sapiens
APFLASAVY

SEQ ID NO: 5197 - protein, 9 aa, Homo sapiens
SAVYAQPPL

SEQ ID NO: 5198 - protein, 9 aa, Homo sapiens
SAVSTQPPL

SEQ ID NO: 5199 - protein, 9 aa, Homo sapiens
RPIKKNSPY

SEQ ID NO: 5200 - protein, 9 aa, Homo sapiens
SPYSTDFIV

SEQ ID NO: 5201 - protein, 9 aa, Homo sapiens
VTKDPSTLK

SEQ ID NO: 5202 - protein, 9 aa, Homo sapiens
VTKDPSTLK

SEQ ID NO: 5203 - protein, 9 aa, Homo sapiens
GSGGSGTGK

SEQ ID NO: 5204 - protein, 9 aa, Homo sapiens
FGFSPTWAM

SEQ ID NO: 5205 - protein, 9 aa, Homo sapiens
WAMASADIV

SEQ ID NO: 5206 - protein, 9 aa, Homo sapiens
HPISNNNSM

SEQ ID NO: 5207 - protein, 9 aa, Homo sapiens
LYTLVLLSR

SEQ ID NO: 5208 - protein, 9 aa, Homo sapiens
LLSSMLSRK

SEQ ID NO: 5209 - protein, 9 aa, Homo sapiens
SMLSRKLSY

SEQ ID NO: 5210 - protein, 9 aa, Homo sapiens
MLSRKLSYK

SEQ ID NO: 5211 - protein, 9 aa, Homo sapiens
MLSRKLSYK

SEQ ID NO: 5212 - protein, 9 aa, Homo sapiens
SSNTITSKK

SEQ ID NO: 5213 - protein, 9 aa, Homo sapiens
SSNTITSKK

SEQ ID NO: 5214 - protein, 9 aa, Homo sapiens
SPSSNTITS

SEQ ID NO: 5215 - protein, 9 aa, Homo sapiens
SAVNPSYNR

SEQ ID NO: 5216 - protein, 9 aa, Homo sapiens
PSYNRGEPK

SEQ ID NO: 5217 - protein, 9 aa, Homo sapiens
SAVNPSYNR

SEQ ID NO: 5218 - protein, 9 aa, Homo sapiens
SYNRGEPKR

SEQ ID NO: 5219 - protein, 9 aa, Homo sapiens
LPPAADLSY

SEQ ID NO: 5220 - protein, 9 aa, Homo sapiens
MASQSGSEI

SEQ ID NO: 5221 - protein, 9 aa, Homo sapiens
MSHSQHSSY

SEQ ID NO: 5222 - protein, 9 aa, Homo sapiens
SHSQHSSYL

SEQ ID NO: 5223 - protein, 9 aa, Homo sapiens
QHSSYLQSY

SEQ ID NO: 5224 - protein, 9 aa, Homo sapiens
LPLGLKEPY

SEQ ID NO: 5225 - protein, 9 aa, Homo sapiens
RRGGGGSEL

SEQ ID NO: 5226 - protein, 9 aa, Homo sapiens
LVLFPYGAK

SEQ ID NO: 5227 - protein, 9 aa, Homo sapiens
FPYGAKGNW

SEQ ID NO: 5228 - protein, 9 aa, Homo sapiens
FYQCCPETL

SEQ ID NO: 5229 - protein, 9 aa, Homo sapiens
TALYSLVPF

SEQ ID NO: 5230 - protein, 9 aa, Homo sapiens
TATIYSLFY

SEQ ID NO: 5231 - protein, 9 aa, Homo sapiens
SFLATATIY

SEQ ID NO: 5232 - protein, 9 aa, Homo sapiens
LATATIYSL

SEQ ID NO: 5233 - protein, 9 aa, Homo sapiens
TATIYSLFY

SEQ ID NO: 5234 - protein, 9 aa, Homo sapiens
KSYLSGHQR

SEQ ID NO: 5235 - protein, 9 aa, Homo sapiens
KSYLSGHQR

SEQ ID NO: 5236 - protein, 9 aa, Homo sapiens
KTRLSTHQR

SEQ ID NO: 5237 - protein, 9 aa, Homo sapiens
TRLSTHQRI

SEQ ID NO: 5238 - protein, 9 aa, Homo sapiens
RSWEDSLER

SEQ ID NO: 5239 - protein, 9 aa, Homo sapiens
RSWEDSLER

SEQ ID NO: 5240 - protein, 9 aa, Homo sapiens
EATKTSCLY

SEQ ID NO: 5241 - protein, 9 aa, Homo sapiens
MAQPGSDCK

SEQ ID NO: 5242 - protein, 9 aa, Homo sapiens
ARLEIDSVL

SEQ ID NO: 5243 - protein, 9 aa, Homo sapiens
HSTDCTYRR

SEQ ID NO: 5244 - protein, 9 aa, Homo sapiens
YRRDCRAPC

SEQ ID NO: 5245 - protein, 9 aa, Homo sapiens
WFEVLSSAY

SEQ ID NO: 5246 - protein, 9 aa, Homo sapiens
EVLSSAYVF

SEQ ID NO: 5247 - protein, 9 aa, Homo sapiens
TLPSTCFQK

SEQ ID NO: 5248 - protein, 9 aa, Homo sapiens
YSCDCFGGR

SEQ ID NO: 5249 - protein, 9 aa, Homo sapiens
GLWGTLFMR

SEQ ID NO: 5250 - protein, 9 aa, Homo sapiens
GLWGTLFMR

SEQ ID NO: 5251 - protein, 9 aa, Homo sapiens
RAGENEDIF

SEQ ID NO: 5252 - protein, 9 aa, Homo sapiens
YRQECEGFL

SEQ ID NO: 5253 - protein, 9 aa, Homo sapiens
SSMRQRLWR

SEQ ID NO: 5254 - protein, 9 aa, Homo sapiens
SSMRQRLWR

SEQ ID NO: 5255 - protein, 9 aa, Homo sapiens
PALPAGSSM

SEQ ID NO: 5256 - protein, 9 aa, Homo sapiens
MIDIAIDCF

SEQ ID NO: 5257 - protein, 9 aa, Homo sapiens
QYKLLKLER

SEQ ID NO: 5258 - protein, 9 aa, Homo sapiens
LVFTPFASF

SEQ ID NO: 5259 - protein, 9 aa, Homo sapiens
FASFSDAFF

SEQ ID NO: 5260 - protein, 9 aa, Homo sapiens
QRHNQVSEQ

SEQ ID NO: 5261 - protein, 9 aa, Homo sapiens
SGLRGGAPR

SEQ ID NO: 5262 - protein, 9 aa, Homo sapiens
NEPFYFHTS

SEQ ID NO: 5263 - protein, 9 aa, Homo sapiens
IVFNEPFYF

SEQ ID NO: 5264 - protein, 9 aa, Homo sapiens
EPFYFHTSL

SEQ ID NO: 5265 - protein, 9 aa, Homo sapiens
FTCLPLGSL

SEQ ID NO: 5266 - protein, 9 aa, Homo sapiens
VFLEPRQVV

SEQ ID NO: 5267 - protein, 9 aa, Homo sapiens
KSFGQLSSL

SEQ ID NO: 5268 - protein, 9 aa, Homo sapiens
YELWAAMPG

SEQ ID NO: 5269 - protein, 9 aa, Homo sapiens
VQYELWAAM

SEQ ID NO: 5270 - protein, 9 aa, Homo sapiens
AAMPGASGV

SEQ ID NO: 5271 - protein, 9 aa, Homo sapiens
LEIPWTLSH

SEQ ID NO: 5272 - protein, 9 aa, Homo sapiens
LSHPSTNEM

SEQ ID NO: 5273 - protein, 9 aa, Homo sapiens
YTTIKMKEM

SEQ ID NO: 5274 - protein, 9 aa, Homo sapiens
FATEVFKAV

SEQ ID NO: 5275 - protein, 9 aa, Homo sapiens
VRYNCHQEL

SEQ ID NO: 5276 - protein, 9 aa, Homo sapiens
QAFERVEDY

SEQ ID NO: 5277 - protein, 9 aa, Homo sapiens
RVEDYIKLI

SEQ ID NO: 5278 - protein, 9 aa, Homo sapiens
TVLLPPNTY

SEQ ID NO: 5279 - protein, 9 aa, Homo sapiens
FDGESAEEI

SEQ ID NO: 5280 - protein, 9 aa, Homo sapiens
YTTLTLIFI

SEQ ID NO: 5281 - protein, 9 aa, Homo sapiens
HELKFFPSD

SEQ ID NO: 5282 - protein, 9 aa, Homo sapiens
FPSDDPEAV

SEQ ID NO: 5283 - protein, 9 aa, Homo sapiens
NECLEARTL

SEQ ID NO: 5284 - protein, 9 aa, Homo sapiens
EAEGRRKAV

SEQ ID NO: 5285 - protein, 9 aa, Homo sapiens
FCDRRFYQI

SEQ ID NO: 5286 - protein, 9 aa, Homo sapiens
TTAFSMPSW

SEQ ID NO: 5287 - protein, 9 aa, Homo sapiens
IEFGLSFPD

SEQ ID NO: 5288 - protein, 9 aa, Homo sapiens
WADYKYQKL

SEQ ID NO: 5289 - protein, 9 aa, Homo sapiens
RSGDLWIPV

SEQ ID NO: 5290 - protein, 9 aa, Homo sapiens
QEEITFKGY

SEQ ID NO: 5291 - protein, 9 aa, Homo sapiens
KGYMANVTV

SEQ ID NO: 5292 - protein, 9 aa, Homo sapiens
YMANVTVTR

SEQ ID NO: 5293 - protein, 9 aa, Homo sapiens
IIQEGQLAV

SEQ ID NO: 5294 - protein, 9 aa, Homo sapiens
IPPDCAVEL

SEQ ID NO: 5295 - protein, 9 aa, Homo sapiens
EAQAPAAEL

SEQ ID NO: 5296 - protein, 9 aa, Homo sapiens
CESRLHTPV

SEQ ID NO: 5297 - protein, 9 aa, Homo sapiens
KLIDALIEI

SEQ ID NO: 5298 - protein, 9 aa, Homo sapiens
KASPNGKPT

SEQ ID NO: 5299 - protein, 9 aa, Homo sapiens
MENEENMQL

SEQ ID NO: 5300 - protein, 9 aa, Homo sapiens
SAFPLVRMM

SEQ ID NO: 5301 - protein, 9 aa, Homo sapiens
RMMENEENM

SEQ ID NO: 5302 - protein, 9 aa, Homo sapiens
IRFIIMVAI

SEQ ID NO: 5303 - protein, 9 aa, Homo sapiens
IMVAIWSAV

SEQ ID NO: 5304 - protein, 9 aa, Homo sapiens
VAIWSAVFL

SEQ ID NO: 5305 - protein, 9 aa, Homo sapiens
NSFSLNRRM

SEQ ID NO: 5306 - protein, 9 aa, Homo sapiens
FPMRPTTFV

SEQ ID NO: 5307 - protein, 9 aa, Homo sapiens
MTFMSSGPL

SEQ ID NO: 5308 - protein, 9 aa, Homo sapiens
MSSGPLVRV

SEQ ID NO: 5309 - protein, 9 aa, Homo sapiens
DIALIQLSF

SEQ ID NO: 5310 - protein, 9 aa, Homo sapiens
IQLSFPLEY

SEQ ID NO: 5311 - protein, 9 aa, Homo sapiens
FPLEYNSVV

SEQ ID NO: 5312 - protein, 9 aa, Homo sapiens
KPFSLLHTI

SEQ ID NO: 5313 - protein, 9 aa, Homo sapiens
QEFRFFTDL

SEQ ID NO: 5314 - protein, 9 aa, Homo sapiens
DQEECMYWY

SEQ ID NO: 5315 - protein, 9 aa, Homo sapiens
EECMYWYNF

SEQ ID NO: 5316 - protein, 9 aa, Homo sapiens
TFFECLQEL

SEQ ID NO: 5317 - protein, 9 aa, Homo sapiens
LLLDLHTKV

SEQ ID NO: 5318 - protein, 9 aa, Homo sapiens
IKVEGKKHI

SEQ ID NO: 5319 - protein, 9 aa, Homo sapiens
FLEEHTSQL

SEQ ID NO: 5320 - protein, 9 aa, Homo sapiens
TERIIAMSY

SEQ ID NO: 5321 - protein, 9 aa, Homo sapiens
YPSSGRQSF

SEQ ID NO: 5322 - protein, 9 aa, Homo sapiens
SVTPALTSF

SEQ ID NO: 5323 - protein, 9 aa, Homo sapiens
TEFILLVFF

SEQ ID NO: 5324 - protein, 9 aa, Homo sapiens
LVTEFILLV

SEQ ID NO: 5325 - protein, 9 aa, Homo sapiens
RAGQHGQAL

SEQ ID NO: 5326 - protein, 9 aa, Homo sapiens
AARCAGRSI

SEQ ID NO: 5327 - protein, 9 aa, Homo sapiens
RCAGRSITV

SEQ ID NO: 5328 - protein, 9 aa, Homo sapiens
YSAKAYDSI

SEQ ID NO: 5329 - protein, 9 aa, Homo sapiens
KAYDSIRVS

SEQ ID NO: 5330 - protein, 9 aa, Homo sapiens
LMEEIQRHL

SEQ ID NO: 5331 - protein, 9 aa, Homo sapiens
NTDPETFKV

SEQ ID NO: 5332 - protein, 9 aa, Homo sapiens
KVLEVSGSM

SEQ ID NO: 5333 - protein, 9 aa, Homo sapiens
EARKMIVQV

SEQ ID NO: 5334 - protein, 9 aa, Homo sapiens
SPYYNLDTV

SEQ ID NO: 5335 - protein, 9 aa, Homo sapiens
LIFPLHNPI

SEQ ID NO: 5336 - protein, 9 aa, Homo sapiens
FPLHNPIIY

SEQ ID NO: 5337 - protein, 9 aa, Homo sapiens
LHNPIIYTL

SEQ ID NO: 5338 - protein, 9 aa, Homo sapiens
VQKPELETF

SEQ ID NO: 5339 - protein, 9 aa, Homo sapiens
NVLESTSRL

SEQ ID NO: 5340 - protein, 9 aa, Homo sapiens
FSTYHSSQM

SEQ ID NO: 5341 - protein, 9 aa, Homo sapiens
LLTESANHL

SEQ ID NO: 5342 - protein, 9 aa, Homo sapiens
ETNSFLKVI

SEQ ID NO: 5343 - protein, 9 aa, Homo sapiens
LYFQRALAL

SEQ ID NO: 5344 - protein, 9 aa, Homo sapiens
FVYRKDAVL

SEQ ID NO: 5345 - protein, 9 aa, Homo sapiens
YRKDAVLVV

SEQ ID NO: 5346 - protein, 9 aa, Homo sapiens
DAVLVVDTY

SEQ ID NO: 5347 - protein, 9 aa, Homo sapiens
HAAAYQNAL

SEQ ID NO: 5348 - protein, 9 aa, Homo sapiens
YQNALANPL

SEQ ID NO: 5349 - protein, 9 aa, Homo sapiens
QEIFGDYPQ

SEQ ID NO: 5350 - protein, 9 aa, Homo sapiens
RVQRITQEI

SEQ ID NO: 5351 - protein, 9 aa, Homo sapiens
KAKIFGSLF

SEQ ID NO: 5352 - protein, 9 aa, Homo sapiens
NPNRVVCPI

SEQ ID NO: 5353 - protein, 9 aa, Homo sapiens
SPEDQALPV

SEQ ID NO: 5354 - protein, 9 aa, Homo sapiens
KASNTSKHI

SEQ ID NO: 5355 - protein, 9 aa, Homo sapiens
LEGPAQPQY

SEQ ID NO: 5356 - protein, 9 aa, Homo sapiens
PAQPQYSPV

SEQ ID NO: 5357 - protein, 9 aa, Homo sapiens
LAKRCKVLV

SEQ ID NO: 5358 - protein, 9 aa, Homo sapiens
YETASLIIM

SEQ ID NO: 5359 - protein, 9 aa, Homo sapiens
PCYETASLI

SEQ ID NO: 5360 - protein, 9 aa, Homo sapiens
YETASLIIM

SEQ ID NO: 5361 - protein, 9 aa, Homo sapiens
RSAEQKAVI

SEQ ID NO: 5362 - protein, 9 aa, Homo sapiens
KAVIRVIPL

SEQ ID NO: 5363 - protein, 9 aa, Homo sapiens
YNFSAEQVL

SEQ ID NO: 5364 - protein, 9 aa, Homo sapiens
QMAGPLCSI

SEQ ID NO: 5365 - protein, 9 aa, Homo sapiens
AARDYVGAL

SEQ ID NO: 5366 - protein, 9 aa, Homo sapiens
YVGALIRPL

SEQ ID NO: 5367 - protein, 9 aa, Homo sapiens
TSKPLLTSV

SEQ ID NO: 5368 - protein, 9 aa, Homo sapiens
LLTSVANTV

SEQ ID NO: 5369 - protein, 9 aa, Homo sapiens
PQFHTNSHI

SEQ ID NO: 5370 - protein, 9 aa, Homo sapiens
REHYHATAM

SEQ ID NO: 5371 - protein, 9 aa, Homo sapiens
HATAMGAKI

SEQ ID NO: 5372 - protein, 9 aa, Homo sapiens
MALVQLVRV

SEQ ID NO: 5373 - protein, 9 aa, Homo sapiens
IGGDSATTV

SEQ ID NO: 5374 - protein, 9 aa, Homo sapiens
REWAKSMTL

SEQ ID NO: 5375 - protein, 9 aa, Homo sapiens
WAKSMTLVL

SEQ ID NO: 5376 - protein, 9 aa, Homo sapiens
LVLEPVLDL

SEQ ID NO: 5377 - protein, 9 aa, Homo sapiens
TASPGVSGV

SEQ ID NO: 5378 - protein, 9 aa, Homo sapiens
YRLARKKPF

SEQ ID NO: 5379 - protein, 9 aa, Homo sapiens
FTGPQCQML

SEQ ID NO: 5380 - protein, 9 aa, Homo sapiens
RLQERRSLV

SEQ ID NO: 5381 - protein, 9 aa, Homo sapiens
KAFNLLSHI

SEQ ID NO: 5382 - protein, 9 aa, Homo sapiens
LSHITTHTI

SEQ ID NO: 5383 - protein, 9 aa, Homo sapiens
LEHGASRAM

SEQ ID NO: 5384 - protein, 9 aa, Homo sapiens
NAAEVRGMV

SEQ ID NO: 5385 - protein, 9 aa, Homo sapiens
FLCKFLFTI

SEQ ID NO: 5386 - protein, 9 aa, Homo sapiens
ISKDPSSLV

SEQ ID NO: 5387 - protein, 9 aa, Homo sapiens
LSHDDIRSL

SEQ ID NO: 5388 - protein, 9 aa, Homo sapiens
QFMDNPAII

SEQ ID NO: 5389 - protein, 9 aa, Homo sapiens
FILKTSQCI

SEQ ID NO: 5390 - protein, 9 aa, Homo sapiens
NASNSCTIL

SEQ ID NO: 5391 - protein, 9 aa, Homo sapiens
ETSEPVVYF

SEQ ID NO: 5392 - protein, 9 aa, Homo sapiens
VVYFLITLL

SEQ ID NO: 5393 - protein, 9 aa, Homo sapiens
LEYNCMRLI

SEQ ID NO: 5394 - protein, 9 aa, Homo sapiens
QMPEDPSTL

SEQ ID NO: 5395 - protein, 9 aa, Homo sapiens
MPEDPSTLV

SEQ ID NO: 5396 - protein, 9 aa, Homo sapiens
NAYHSYCYY

SEQ ID NO: 5397 - protein, 9 aa, Homo sapiens
VEHELEKVL

SEQ ID NO: 5398 - protein, 9 aa, Homo sapiens
FAVLASTVF

SEQ ID NO: 5399 - protein, 9 aa, Homo sapiens
ILYGHANEV

SEQ ID NO: 5400 - protein, 9 aa, Homo sapiens
DADLLIDVL

SEQ ID NO: 5401 - protein, 9 aa, Homo sapiens
EAQDGFNVT

SEQ ID NO: 5402 - protein, 9 aa, Homo sapiens
NPHACVYVL

SEQ ID NO: 5403 - protein, 9 aa, Homo sapiens
YVLRGWNQL

SEQ ID NO: 5404 - protein, 9 aa, Homo sapiens
VPMQDIKMI

SEQ ID NO: 5405 - protein, 9 aa, Homo sapiens
SAEEPLCPF

SEQ ID NO: 5406 - protein, 9 aa, Homo sapiens
RPEPARPTM

SEQ ID NO: 5407 - protein, 9 aa, Homo sapiens
TSYETTDKV

SEQ ID NO: 5408 - protein, 9 aa, Homo sapiens
YNQRKADLI

SEQ ID NO: 5409 - protein, 9 aa, Homo sapiens
KADLINRSI

SEQ ID NO: 5410 - protein, 9 aa, Homo sapiens
LATAKHNLL

SEQ ID NO: 5411 - protein, 9 aa, Homo sapiens
TAKHNLLRV

SEQ ID NO: 5412 - protein, 9 aa, Homo sapiens
AAGDDGQAV

SEQ ID NO: 5413 - protein, 9 aa, Homo sapiens
FTQFSRKQI

SEQ ID NO: 5414 - protein, 9 aa, Homo sapiens
VADRLARAL

SEQ ID NO: 5415 - protein, 9 aa, Homo sapiens
NSEEHSARY

SEQ ID NO: 5416 - protein, 9 aa, Homo sapiens
YLSSRSLKL

SEQ ID NO: 5417 - protein, 9 aa, Homo sapiens
LSSRSLKLI

SEQ ID NO: 5418 - protein, 9 aa, Homo sapiens
EALGYPAGV

SEQ ID NO: 5419 - protein, 9 aa, Homo sapiens
YPAGVGTPV

SEQ ID NO: 5420 - protein, 9 aa, Homo sapiens
FLEDEGLYI

SEQ ID NO: 5421 - protein, 9 aa, Homo sapiens
FAFHNDNGS

SEQ ID NO: 5422 - protein, 9 aa, Homo sapiens
IVESIGEAV

SEQ ID NO: 5423 - protein, 9 aa, Homo sapiens
SIGEAVTTV

SEQ ID NO: 5424 - protein, 9 aa, Homo sapiens
DVYPELANL

SEQ ID NO: 5425 - protein, 9 aa, Homo sapiens
KPSPWPRSM

SEQ ID NO: 5426 - protein, 9 aa, Homo sapiens
TIPPAIRSY

SEQ ID NO: 5427 - protein, 9 aa, Homo sapiens
SVPEMSVVV

SEQ ID NO: 5428 - protein, 9 aa, Homo sapiens
MSVVVTSVV

SEQ ID NO: 5429 - protein, 9 aa, Homo sapiens
MALQGISVM

SEQ ID NO: 5430 - protein, 9 aa, Homo sapiens
KSMDNYSHF

SEQ ID NO: 5431 - protein, 9 aa, Homo sapiens
FEDPDVNTT

SEQ ID NO: 5432 - protein, 9 aa, Homo sapiens
EAPFDLSVI

SEQ ID NO: 5433 - protein, 9 aa, Homo sapiens
APFDLSVIY

SEQ ID NO: 5434 - protein, 9 aa, Homo sapiens
IPLVVRVFI

SEQ ID NO: 5435 - protein, 9 aa, Homo sapiens
NAEAHKSQY

SEQ ID NO: 5436 - protein, 9 aa, Homo sapiens
KQGDNCDSI

SEQ ID NO: 5437 - protein, 9 aa, Homo sapiens
DEVLIHSSQ

SEQ ID NO: 5438 - protein, 9 aa, Homo sapiens
VAGPVDEVL

SEQ ID NO: 5439 - protein, 9 aa, Homo sapiens
FKWRKIQYM

SEQ ID NO: 5440 - protein, 9 aa, Homo sapiens
KESYSAYVY

SEQ ID NO: 5441 - protein, 9 aa, Homo sapiens
YSAYVYKVL

SEQ ID NO: 5442 - protein, 9 aa, Homo sapiens
FQPGAAQAL

SEQ ID NO: 5443 - protein, 9 aa, Homo sapiens
LEFRDITSH

SEQ ID NO: 5444 - protein, 9 aa, Homo sapiens
EFRDITSHV

SEQ ID NO: 5445 - protein, 9 aa, Homo sapiens
FVLVGPPSL

SEQ ID NO: 5446 - protein, 9 aa, Homo sapiens
VLVGPPSLI

SEQ ID NO: 5447 - protein, 9 aa, Homo sapiens
LVGPPSLIL

SEQ ID NO: 5448 - protein, 9 aa, Homo sapiens
RAERKATRM

SEQ ID NO: 5449 - protein, 9 aa, Homo sapiens
LEDLNAVLF

SEQ ID NO: 5450 - protein, 9 aa, Homo sapiens
AALEDLNAV

SEQ ID NO: 5451 - protein, 9 aa, Homo sapiens
TTCENQSGF

SEQ ID NO: 5452 - protein, 9 aa, Homo sapiens
YTLNLSCNL

SEQ ID NO: 5453 - protein, 9 aa, Homo sapiens
FANFDLLSL

SEQ ID NO: 5454 - protein, 9 aa, Homo sapiens
NVVPSPLAV

SEQ ID NO: 5455 - protein, 9 aa, Homo sapiens
VPSPLAVPL

SEQ ID NO: 5456 - protein, 9 aa, Homo sapiens
LAVPLQPPF

SEQ ID NO: 5457 - protein, 9 aa, Homo sapiens
VSLNNELTV

SEQ ID NO: 5458 - protein, 9 aa, Homo sapiens
SSLSSASPV

SEQ ID NO: 5459 - protein, 9 aa, Homo sapiens
YSAPPDAYL

SEQ ID NO: 5460 - protein, 9 aa, Homo sapiens
TFSPHGVPI

SEQ ID NO: 5461 - protein, 9 aa, Homo sapiens
FSPHGVPIY

SEQ ID NO: 5462 - protein, 9 aa, Homo sapiens
TAQNSDVFV

SEQ ID NO: 5463 - protein, 9 aa, Homo sapiens
PASQPTPFV

SEQ ID NO: 5464 - protein, 9 aa, Homo sapiens
FVLHHAASC

SEQ ID NO: 5465 - protein, 9 aa, Homo sapiens
RSLQKVCRV

SEQ ID NO: 5466 - protein, 9 aa, Homo sapiens
LLFDHLVQL

SEQ ID NO: 5467 - protein, 9 aa, Homo sapiens
VQLFFTSTI

SEQ ID NO: 5468 - protein, 9 aa, Homo sapiens
FVLDPAGDL

SEQ ID NO: 5469 - protein, 9 aa, Homo sapiens
DLYYCWLFV

SEQ ID NO: 5470 - protein, 9 aa, Homo sapiens
LYYCWLFVI

SEQ ID NO: 5471 - protein, 9 aa, Homo sapiens
LLLLGLGLI

SEQ ID NO: 5472 - protein, 9 aa, Homo sapiens
LLGLGLITV

SEQ ID NO: 5473 - protein, 9 aa, Homo sapiens
ITVTGLHCV

SEQ ID NO: 5474 - protein, 9 aa, Homo sapiens
SLASGRFMA

SEQ ID NO: 5475 - protein, 9 aa, Homo sapiens
EIAQLAVSW

SEQ ID NO: 5476 - protein, 9 aa, Homo sapiens
FHDGHSQHS

SEQ ID NO: 5477 - protein, 9 aa, Homo sapiens
FLALGGWVV

SEQ ID NO: 5478 - protein, 9 aa, Homo sapiens
ALGGWVVII

SEQ ID NO: 5479 - protein, 9 aa, Homo sapiens
ALGGWVVII

SEQ ID NO: 5480 - protein, 9 aa, Homo sapiens
TLCPALHTL

SEQ ID NO: 5481 - protein, 9 aa, Homo sapiens
KSPEGFFHV

SEQ ID NO: 5482 - protein, 9 aa, Homo sapiens
WLLDDWGPA

SEQ ID NO: 5483 - protein, 9 aa, Homo sapiens
FYTMFTHLL

SEQ ID NO: 5484 - protein, 9 aa, Homo sapiens
KVGTLTYVW

SEQ ID NO: 5485 - protein, 9 aa, Homo sapiens
YVFLRLQGA

SEQ ID NO: 5486 - protein, 9 aa, Homo sapiens
FICFLNFLI

SEQ ID NO: 5487 - protein, 9 aa, Homo sapiens
FLNFLILVV

SEQ ID NO: 5488 - protein, 9 aa, Homo sapiens
GLQERLKQV

SEQ ID NO: 5489 - protein, 9 aa, Homo sapiens
SLLQGSPHV

SEQ ID NO: 5490 - protein, 9 aa, Homo sapiens
RTLQLSLTE

SEQ ID NO: 5491 - protein, 9 aa, Homo sapiens
YMYDSPGEL

SEQ ID NO: 5492 - protein, 9 aa, Homo sapiens
YMYDSPGEL

SEQ ID NO: 5493 - protein, 9 aa, Homo sapiens
MRCDIVRKI

SEQ ID NO: 5494 - protein, 9 aa, Homo sapiens
SAAFIFSYV

SEQ ID NO: 5495 - protein, 9 aa, Homo sapiens
AAFIFSYVV

SEQ ID NO: 5496 - protein, 9 aa, Homo sapiens
FIFSYVVAV

SEQ ID NO: 5497 - protein, 9 aa, Homo sapiens
SSAAFIFSY

SEQ ID NO: 5498 - protein, 9 aa, Homo sapiens
FIFSYVVAV

SEQ ID NO: 5499 - protein, 9 aa, Homo sapiens
SLANSFVGT

SEQ ID NO: 5500 - protein, 9 aa, Homo sapiens
SMASLANSF

SEQ ID NO: 5501 - protein, 9 aa, Homo sapiens
CLDDSVEGL

SEQ ID NO: 5502 - protein, 9 aa, Homo sapiens
FRTTFANVV

SEQ ID NO: 5503 - protein, 9 aa, Homo sapiens
LLGSSNSPA

SEQ ID NO: 5504 - protein, 9 aa, Homo sapiens
TIIHATHLV

SEQ ID NO: 5505 - protein, 9 aa, Homo sapiens
SLDELLQVL

SEQ ID NO: 5506 - protein, 9 aa, Homo sapiens
FAMMRHHEM

SEQ ID NO: 5507 - protein, 9 aa, Homo sapiens
RHHEMNGSL

SEQ ID NO: 5508 - protein, 9 aa, Homo sapiens
VTFPHSKDV

SEQ ID NO: 5509 - protein, 9 aa, Homo sapiens
RAFDKNPHL

SEQ ID NO: 5510 - protein, 9 aa, Homo sapiens
DKNPHLRYI

SEQ ID NO: 5511 - protein, 9 aa, Homo sapiens
KILHSHALV

SEQ ID NO: 5512 - protein, 9 aa, Homo sapiens
LVAENLCKL

SEQ ID NO: 5513 - protein, 9 aa, Homo sapiens
HRHEAVGRL

SEQ ID NO: 5514 - protein, 9 aa, Homo sapiens
GRLEQHRSL

SEQ ID NO: 5515 - protein, 9 aa, Homo sapiens
ALPPCLIPL

SEQ ID NO: 5516 - protein, 9 aa, Homo sapiens
KLNVLKILL

SEQ ID NO: 5517 - protein, 9 aa, Homo sapiens
NVLKILLYL

SEQ ID NO: 5518 - protein, 9 aa, Homo sapiens
KLNVLKILL

SEQ ID NO: 5519 - protein, 9 aa, Homo sapiens
ERYRLPSEL

SEQ ID NO: 5520 - protein, 9 aa, Homo sapiens
SLGHAHWIL

SEQ ID NO: 5521 - protein, 9 aa, Homo sapiens
STSQGTFTF

SEQ ID NO: 5522 - protein, 9 aa, Homo sapiens
MLPSCAVRA

SEQ ID NO: 5523 - protein, 9 aa, Homo sapiens
TVHGVSQAF

SEQ ID NO: 5524 - protein, 9 aa, Homo sapiens
FLTSHHLKV

SEQ ID NO: 5525 - protein, 9 aa, Homo sapiens
KTFLTSHHL

SEQ ID NO: 5526 - protein, 9 aa, Homo sapiens
IRRPMNVFM

SEQ ID NO: 5527 - protein, 9 aa, Homo sapiens
RRPMNVFMI

SEQ ID NO: 5528 - protein, 9 aa, Homo sapiens
LLLRLLLMI

SEQ ID NO: 5529 - protein, 9 aa, Homo sapiens
LLLMIILPL

SEQ ID NO: 5530 - protein, 9 aa, Homo sapiens
LLMIILPLV

SEQ ID NO: 5531 - protein, 9 aa, Homo sapiens
LMIILPLVV

SEQ ID NO: 5532 - protein, 9 aa, Homo sapiens
YRENKKAEL

SEQ ID NO: 5533 - protein, 9 aa, Homo sapiens
KHKEAVLMF

SEQ ID NO: 5534 - protein, 9 aa, Homo sapiens
IRFAETDGL

SEQ ID NO: 5535 - protein, 9 aa, Homo sapiens
KRTKNGEEV

SEQ ID NO: 5536 - protein, 9 aa, Homo sapiens
FSYSPIWLL

SEQ ID NO: 5537 - protein, 9 aa, Homo sapiens
YSPIWLLEV

SEQ ID NO: 5538 - protein, 9 aa, Homo sapiens
WLLEVCVPL

SEQ ID NO: 5539 - protein, 9 aa, Homo sapiens
ASFSYSPIW

SEQ ID NO: 5540 - protein, 9 aa, Homo sapiens
FSYSPIWLL

SEQ ID NO: 5541 - protein, 9 aa, Homo sapiens
YTDSPCLRV

SEQ ID NO: 5542 - protein, 9 aa, Homo sapiens
MVQSLVDTI

SEQ ID NO: 5543 - protein, 9 aa, Homo sapiens
ALAASPSQA

SEQ ID NO: 5544 - protein, 9 aa, Homo sapiens
KLPLDIDPV

SEQ ID NO: 5545 - protein, 9 aa, Homo sapiens
FLLLFAQLL

SEQ ID NO: 5546 - protein, 9 aa, Homo sapiens
SRSFASTFI

SEQ ID NO: 5547 - protein, 9 aa, Homo sapiens
MLVDDAHGL

SEQ ID NO: 5548 - protein, 9 aa, Homo sapiens
FSRAYRKSI

SEQ ID NO: 5549 - protein, 9 aa, Homo sapiens
RRGTQRGEL

SEQ ID NO: 5550 - protein, 9 aa, Homo sapiens
SHFVDVEGV

SEQ ID NO: 5551 - protein, 9 aa, Homo sapiens
WLCRLLLWA

SEQ ID NO: 5552 - protein, 9 aa, Homo sapiens
ERWLCRLLL

SEQ ID NO: 5553 - protein, 9 aa, Homo sapiens
HQLGVVVEV

SEQ ID NO: 5554 - protein, 9 aa, Homo sapiens
CRSYNRGLI

SEQ ID NO: 5555 - protein, 9 aa, Homo sapiens
RRHLQPHDV

SEQ ID NO: 5556 - protein, 9 aa, Homo sapiens
AALSSSLLV

SEQ ID NO: 5557 - protein, 9 aa, Homo sapiens
STAMAVAAL

SEQ ID NO: 5558 - protein, 9 aa, Homo sapiens
MVALFSPSI

SEQ ID NO: 5559 - protein, 9 aa, Homo sapiens
ALFSPSIPL

SEQ ID NO: 5560 - protein, 9 aa, Homo sapiens
MVALFSPSI

SEQ ID NO: 5561 - protein, 9 aa, Homo sapiens
ALFSPSIPL

SEQ ID NO: 5562 - protein, 9 aa, Homo sapiens
KAFSRPSTL

SEQ ID NO: 5563 - protein, 9 aa, Homo sapiens
SLNHSWFQL

SEQ ID NO: 5564 - protein, 9 aa, Homo sapiens
GLACIDLIL

SEQ ID NO: 5565 - protein, 9 aa, Homo sapiens
RLVWELREL

SEQ ID NO: 5566 - protein, 9 aa, Homo sapiens
LVWELRELL

SEQ ID NO: 5567 - protein, 9 aa, Homo sapiens
STVAVVVLV

SEQ ID NO: 5568 - protein, 9 aa, Homo sapiens
YHANSKAHM

SEQ ID NO: 5569 - protein, 9 aa, Homo sapiens
GREQQVQLI

SEQ ID NO: 5570 - protein, 9 aa, Homo sapiens
GRMDRGYSL

SEQ ID NO: 5571 - protein, 9 aa, Homo sapiens
SVSSETSTV

SEQ ID NO: 5572 - protein, 9 aa, Homo sapiens
CLSNFTAPI

SEQ ID NO: 5573 - protein, 9 aa, Homo sapiens
CLSNFTAPI

SEQ ID NO: 5574 - protein, 9 aa, Homo sapiens
SLLLLHLCL

SEQ ID NO: 5575 - protein, 9 aa, Homo sapiens
LLLHLCLHT

SEQ ID NO: 5576 - protein, 9 aa, Homo sapiens
ALQTLDTEL

SEQ ID NO: 5577 - protein, 9 aa, Homo sapiens
RLSVLVLML

SEQ ID NO: 5578 - protein, 9 aa, Homo sapiens
RLSVLVLML

SEQ ID NO: 5579 - protein, 9 aa, Homo sapiens
SRIRLSVLV

SEQ ID NO: 5580 - protein, 9 aa, Homo sapiens
IRLSVLVLM

SEQ ID NO: 5581 - protein, 9 aa, Homo sapiens
RSHSGEQPF

SEQ ID NO: 5582 - protein, 9 aa, Homo sapiens
PGAARRQQL

SEQ ID NO: 5583 - protein, 9 aa, Homo sapiens
VLDDFKRFK

SEQ ID NO: 5584 - protein, 9 aa, Homo sapiens
ALQRMSVVV

SEQ ID NO: 5585 - protein, 9 aa, Homo sapiens
QRMSVVVAW

SEQ ID NO: 5586 - protein, 9 aa, Homo sapiens
QVFRNHLGR

SEQ ID NO: 5587 - protein, 9 aa, Homo sapiens
HLGRYCLEH

SEQ ID NO: 5588 - protein, 9 aa, Homo sapiens
VFRNHLGRY

SEQ ID NO: 5589 - protein, 9 aa, Homo sapiens
LTGEFTVEP

SEQ ID NO: 5590 - protein, 9 aa, Homo sapiens
QVFSACRPL

SEQ ID NO: 5591 - protein, 9 aa, Homo sapiens
GAAAAAGSK

SEQ ID NO: 5592 - protein, 9 aa, Homo sapiens
IGRLRPHFL

SEQ ID NO: 5593 - protein, 9 aa, Homo sapiens
SSNGPHGSV

SEQ ID NO: 5594 - protein, 9 aa, Homo sapiens
KLGDFVAAL

SEQ ID NO: 5595 - protein, 9 aa, Homo sapiens
AALHRRLGW

SEQ ID NO: 5596 - protein, 9 aa, Homo sapiens
ALWFRKRCF

SEQ ID NO: 5597 - protein, 9 aa, Homo sapiens
TLFTYARPR

SEQ ID NO: 5598 - protein, 9 aa, Homo sapiens
SSTLFTYAR

SEQ ID NO: 5599 - protein, 9 aa, Homo sapiens
FTYARPRAM

SEQ ID NO: 5600 - protein, 9 aa, Homo sapiens
FTYARPRAM

SEQ ID NO: 5601 - protein, 9 aa, Homo sapiens
YARPRAMYT

SEQ ID NO: 5602 - protein, 9 aa, Homo sapiens
NTREHDQLI

SEQ ID NO: 5603 - protein, 9 aa, Homo sapiens
GLRSGNLRD

SEQ ID NO: 5604 - protein, 9 aa, Homo sapiens
RSGNLRDRF

SEQ ID NO: 5605 - protein, 9 aa, Homo sapiens
NLRDRFWLV

SEQ ID NO: 5606 - protein, 9 aa, Homo sapiens
HTLTFFING

SEQ ID NO: 5607 - protein, 9 aa, Homo sapiens
GAHKRPASV

SEQ ID NO: 5608 - protein, 9 aa, Homo sapiens
GAHKRPASV

SEQ ID NO: 5609 - protein, 9 aa, Homo sapiens
ASVSSSAAV

SEQ ID NO: 5610 - protein, 9 aa, Homo sapiens
RAFMKILGK

SEQ ID NO: 5611 - protein, 9 aa, Homo sapiens
EVTRAFMKI

SEQ ID NO: 5612 - protein, 9 aa, Homo sapiens
LTVHVTQPK

SEQ ID NO: 5613 - protein, 9 aa, Homo sapiens
VSAFSTWEK

SEQ ID NO: 5614 - protein, 9 aa, Homo sapiens
STWEKELHK

SEQ ID NO: 5615 - protein, 9 aa, Homo sapiens
NVQEIVFVV

SEQ ID NO: 5616 - protein, 9 aa, Homo sapiens
ALKRTLTNR

SEQ ID NO: 5617 - protein, 9 aa, Homo sapiens
RTLTNRFKI

SEQ ID NO: 5618 - protein, 9 aa, Homo sapiens
LTNRFKIPI

SEQ ID NO: 5619 - protein, 9 aa, Homo sapiens
RTLTNRFKI

SEQ ID NO: 5620 - protein, 9 aa, Homo sapiens
LTNRFKIPI

SEQ ID NO: 5621 - protein, 9 aa, Homo sapiens
ISIPLDSNM

SEQ ID NO: 5622 - protein, 9 aa, Homo sapiens
RSVFPSTIV

SEQ ID NO: 5623 - protein, 9 aa, Homo sapiens
KVFGLSEAF

SEQ ID NO: 5624 - protein, 9 aa, Homo sapiens
QVDEHSKPP

SEQ ID NO: 5625 - protein, 9 aa, Homo sapiens
RVSVWPVAF

SEQ ID NO: 5626 - protein, 9 aa, Homo sapiens
MRSTRRVSV

SEQ ID NO: 5627 - protein, 9 aa, Homo sapiens
VSVWPVAFV

SEQ ID NO: 5628 - protein, 9 aa, Homo sapiens
VKVKSPVEK

SEQ ID NO: 5629 - protein, 9 aa, Homo sapiens
KVKSPVEKK

SEQ ID NO: 5630 - protein, 9 aa, Homo sapiens
ALSFSYIAK

SEQ ID NO: 5631 - protein, 9 aa, Homo sapiens
KMFLAALSF

SEQ ID NO: 5632 - protein, 9 aa, Homo sapiens
LAALSFSYI

SEQ ID NO: 5633 - protein, 9 aa, Homo sapiens
AMGFQSMVI

SEQ ID NO: 5634 - protein, 9 aa, Homo sapiens
LAMGFQSMV

SEQ ID NO: 5635 - protein, 9 aa, Homo sapiens
AMGFQSMVI

SEQ ID NO: 5636 - protein, 9 aa, Homo sapiens
VVGAGGVGK

SEQ ID NO: 5637 - protein, 9 aa, Homo sapiens
LSGEGVSPV

SEQ ID NO: 5638 - protein, 9 aa, Homo sapiens
GVSPVNISV

SEQ ID NO: 5639 - protein, 9 aa, Homo sapiens
AIIYTVELK

SEQ ID NO: 5640 - protein, 9 aa, Homo sapiens
IIYTVELKR

SEQ ID NO: 5641 - protein, 9 aa, Homo sapiens
ELKRYGGPL

SEQ ID NO: 5642 - protein, 9 aa, Homo sapiens
DLERKYAVL

SEQ ID NO: 5643 - protein, 9 aa, Homo sapiens
SKHSDVFAL

SEQ ID NO: 5644 - protein, 9 aa, Homo sapiens
CYHCHVYPY

SEQ ID NO: 5645 - protein, 9 aa, Homo sapiens
LMITVAGLK

SEQ ID NO: 5646 - protein, 9 aa, Homo sapiens
GLKLLRSSF

SEQ ID NO: 5647 - protein, 9 aa, Homo sapiens
RTSTDLQVL

SEQ ID NO: 5648 - protein, 9 aa, Homo sapiens
QPGGNFSCI

SEQ ID NO: 5649 - protein, 9 aa, Homo sapiens
RLLILHGHW

SEQ ID NO: 5650 - protein, 9 aa, Homo sapiens
HGHWCYSRL

SEQ ID NO: 5651 - protein, 9 aa, Homo sapiens
ASSGLLLMI

SEQ ID NO: 5652 - protein, 9 aa, Homo sapiens
ASSGLLLMI

SEQ ID NO: 5653 - protein, 9 aa, Homo sapiens
MVRQRQQDL

SEQ ID NO: 5654 - protein, 9 aa, Homo sapiens
SSIFRTNTF

SEQ ID NO: 5655 - protein, 9 aa, Homo sapiens
SSIFRTNTF

SEQ ID NO: 5656 - protein, 9 aa, Homo sapiens
GRQPQPVHL

SEQ ID NO: 5657 - protein, 9 aa, Homo sapiens
RDMKGALER

SEQ ID NO: 5658 - protein, 9 aa, Homo sapiens
TALQEEEEL

SEQ ID NO: 5659 - protein, 9 aa, Homo sapiens
ALGKLLPRE

SEQ ID NO: 5660 - protein, 9 aa, Homo sapiens
ETLCTELVL

SEQ ID NO: 5661 - protein, 9 aa, Homo sapiens
ETLCTELVL

SEQ ID NO: 5662 - protein, 9 aa, Homo sapiens
LLRARRLAK

SEQ ID NO: 5663 - protein, 9 aa, Homo sapiens
VELLRARRL

SEQ ID NO: 5664 - protein, 9 aa, Homo sapiens
DLKSYLRSL

SEQ ID NO: 5665 - protein, 9 aa, Homo sapiens
HLRTHTGYK

SEQ ID NO: 5666 - protein, 9 aa, Homo sapiens
RTHTGYKPY

SEQ ID NO: 5667 - protein, 9 aa, Homo sapiens
TRRPPAPNL

SEQ ID NO: 5668 - protein, 9 aa, Homo sapiens
IPYFTTSGI

SEQ ID NO: 5669 - protein, 9 aa, Homo sapiens
GLSHLQYLF

SEQ ID NO: 5670 - protein, 9 aa, Homo sapiens
LSHLQYLFI

SEQ ID NO: 5671 - protein, 9 aa, Homo sapiens
KIPQLTLNF

SEQ ID NO: 5672 - protein, 9 aa, Homo sapiens
STINKIPQL

SEQ ID NO: 5673 - protein, 9 aa, Homo sapiens
TPLIAAGVI

SEQ ID NO: 5674 - protein, 9 aa, Homo sapiens
RTPLIAAGV

SEQ ID NO: 5675 - protein, 9 aa, Homo sapiens
DTYPRGPAK

SEQ ID NO: 5676 - protein, 9 aa, Homo sapiens
KRDIGTQTV

SEQ ID NO: 5677 - protein, 9 aa, Homo sapiens
SREPEVALY

SEQ ID NO: 5678 - protein, 9 aa, Homo sapiens
LLRGLLARL

SEQ ID NO: 5679 - protein, 9 aa, Homo sapiens
MPRSPGTRL

SEQ ID NO: 5680 - protein, 9 aa, Homo sapiens
SPGTRLKPA

SEQ ID NO: 5681 - protein, 9 aa, Homo sapiens
ELNPRGRNV

SEQ ID NO: 5682 - protein, 9 aa, Homo sapiens
STDGHSSYG

SEQ ID NO: 5683 - protein, 9 aa, Homo sapiens
RSAIFLGPQ

SEQ ID NO: 5684 - protein, 9 aa, Homo sapiens
IFLGPQGSL

SEQ ID NO: 5685 - protein, 9 aa, Homo sapiens
SVVIPDLRK

SEQ ID NO: 5686 - protein, 9 aa, Homo sapiens
TQRPRTALL

SEQ ID NO: 5687 - protein, 9 aa, Homo sapiens
WRGTSIASL

SEQ ID NO: 5688 - protein, 9 aa, Homo sapiens
AESSLALEI

SEQ ID NO: 5689 - protein, 9 aa, Homo sapiens
SSISSFKRK

SEQ ID NO: 5690 - protein, 9 aa, Homo sapiens
SSFKRKISF

SEQ ID NO: 5691 - protein, 9 aa, Homo sapiens
SFKRKISFA

SEQ ID NO: 5692 - protein, 9 aa, Homo sapiens
EILGKGDPV

SEQ ID NO: 5693 - protein, 9 aa, Homo sapiens
ELQRRLKRL

SEQ ID NO: 5694 - protein, 9 aa, Homo sapiens
RRLKRLYPA

SEQ ID NO: 5695 - protein, 9 aa, Homo sapiens
VRFLHRDIY

SEQ ID NO: 5696 - protein, 9 aa, Homo sapiens
SRGQRELEF

SEQ ID NO: 5697 - protein, 9 aa, Homo sapiens
ATEFSLQQV

SEQ ID NO: 5698 - protein, 9 aa, Homo sapiens
LELQRSAQL

SEQ ID NO: 5699 - protein, 9 aa, Homo sapiens
TVEHSFVHT

SEQ ID NO: 5700 - protein, 9 aa, Homo sapiens
HSFVHTVRK

SEQ ID NO: 5701 - protein, 9 aa, Homo sapiens
TVRKITLEV

SEQ ID NO: 5702 - protein, 9 aa, Homo sapiens
YVQTTSTEM

SEQ ID NO: 5703 - protein, 9 aa, Homo sapiens
KCNRTVHDV

SEQ ID NO: 5704 - protein, 9 aa, Homo sapiens
SSNEVTIMV

SEQ ID NO: 5705 - protein, 9 aa, Homo sapiens
VTIMVSSIV

SEQ ID NO: 5706 - protein, 9 aa, Homo sapiens
HLRKRLESH

SEQ ID NO: 5707 - protein, 9 aa, Homo sapiens
RKRLESHPA

SEQ ID NO: 5708 - protein, 9 aa, Homo sapiens
PLLSCQFLK

SEQ ID NO: 5709 - protein, 9 aa, Homo sapiens
MPLLSCQFL

SEQ ID NO: 5710 - protein, 9 aa, Homo sapiens
MPLLSCQFL

SEQ ID NO: 5711 - protein, 9 aa, Homo sapiens
CRRPPLGLY

SEQ ID NO: 5712 - protein, 9 aa, Homo sapiens
STSEEEEAF

SEQ ID NO: 5713 - protein, 9 aa, Homo sapiens
STSEEEEAF

SEQ ID NO: 5714 - protein, 9 aa, Homo sapiens
PTADELHFL

SEQ ID NO: 5715 - protein, 9 aa, Homo sapiens
LVGDLASVV

SEQ ID NO: 5716 - protein, 9 aa, Homo sapiens
SSYQVLVLP

SEQ ID NO: 5717 - protein, 9 aa, Homo sapiens
LPLALQSTF

SEQ ID NO: 5718 - protein, 9 aa, Homo sapiens
SYQVLVLPL

SEQ ID NO: 5719 - protein, 9 aa, Homo sapiens
SSYQVLVLP

SEQ ID NO: 5720 - protein, 9 aa, Homo sapiens
ASTEATHEI

SEQ ID NO: 5721 - protein, 9 aa, Homo sapiens
RSSDPRLPK

SEQ ID NO: 5722 - protein, 9 aa, Homo sapiens
FRRSSDPRL

SEQ ID NO: 5723 - protein, 9 aa, Homo sapiens
VAMTVALSV

SEQ ID NO: 5724 - protein, 9 aa, Homo sapiens
LLRALRRDL

SEQ ID NO: 5725 - protein, 9 aa, Homo sapiens
ERLAHCTEL

SEQ ID NO: 5726 - protein, 9 aa, Homo sapiens
PARDLEQYV

SEQ ID NO: 5727 - protein, 9 aa, Homo sapiens
SVHALDLEW

SEQ ID NO: 5728 - protein, 9 aa, Homo sapiens
LDLEWRSGL

SEQ ID NO: 5729 - protein, 9 aa, Homo sapiens
RPSVHALDL

SEQ ID NO: 5730 - protein, 9 aa, Homo sapiens
VLKEKSLIV

SEQ ID NO: 5731 - protein, 9 aa, Homo sapiens
KSLIVKQKL

SEQ ID NO: 5732 - protein, 9 aa, Homo sapiens
WREERDQLV

SEQ ID NO: 5733 - protein, 9 aa, Homo sapiens
VVLDKGRVV

SEQ ID NO: 5734 - protein, 9 aa, Homo sapiens
FQIKVNLMT

SEQ ID NO: 5735 - protein, 9 aa, Homo sapiens
LLREKVEFL

SEQ ID NO: 5736 - protein, 9 aa, Homo sapiens
QRDKARLLR

SEQ ID NO: 5737 - protein, 9 aa, Homo sapiens
KARLLREKV

SEQ ID NO: 5738 - protein, 9 aa, Homo sapiens
WTGNALSPL

SEQ ID NO: 5739 - protein, 9 aa, Homo sapiens
LPIYSPEKV

SEQ ID NO: 5740 - protein, 9 aa, Homo sapiens
FRVLRNGAL

SEQ ID NO: 5741 - protein, 9 aa, Homo sapiens
GALTRPNCM

SEQ ID NO: 5742 - protein, 9 aa, Homo sapiens
FRVLRNGAL

SEQ ID NO: 5743 - protein, 9 aa, Homo sapiens
GALTRPNCM

SEQ ID NO: 5744 - protein, 9 aa, Homo sapiens
FCQETSPEM

SEQ ID NO: 5745 - protein, 9 aa, Homo sapiens
QQQERAHLL

SEQ ID NO: 5746 - protein, 9 aa, Homo sapiens
QQQERAHLL

SEQ ID NO: 5747 - protein, 9 aa, Homo sapiens
KPKNATVLI

SEQ ID NO: 5748 - protein, 9 aa, Homo sapiens
QLIPLFQRV

SEQ ID NO: 5749 - protein, 9 aa, Homo sapiens
PLFQRVGRL

SEQ ID NO: 5750 - protein, 9 aa, Homo sapiens
DVYEHQLIP

SEQ ID NO: 5751 - protein, 9 aa, Homo sapiens
AQWHMEDVI

SEQ ID NO: 5752 - protein, 9 aa, Homo sapiens
DVIEDIIGM

SEQ ID NO: 5753 - protein, 9 aa, Homo sapiens
NAQWHMEDV

SEQ ID NO: 5754 - protein, 9 aa, Homo sapiens
FRRPSRVHY

SEQ ID NO: 5755 - protein, 9 aa, Homo sapiens
RRPSRVHYY

SEQ ID NO: 5756 - protein, 9 aa, Homo sapiens
KAEEPSDLI

SEQ ID NO: 5757 - protein, 9 aa, Homo sapiens
TTGGSLLLL

SEQ ID NO: 5758 - protein, 9 aa, Homo sapiens
SSTGQSSSY

SEQ ID NO: 5759 - protein, 9 aa, Homo sapiens
SSTGQSSSY

SEQ ID NO: 5760 - protein, 9 aa, Homo sapiens
STFRHPFPL

SEQ ID NO: 5761 - protein, 9 aa, Homo sapiens
TTSTFRHPF

SEQ ID NO: 5762 - protein, 9 aa, Homo sapiens
LATPAFPAM

SEQ ID NO: 5763 - protein, 9 aa, Homo sapiens
PVLPLSGHV

SEQ ID NO: 5764 - protein, 9 aa, Homo sapiens
VPAPPVLPL

SEQ ID NO: 5765 - protein, 9 aa, Homo sapiens
LPFYGCAFF

SEQ ID NO: 5766 - protein, 9 aa, Homo sapiens
LLIFRSVST

SEQ ID NO: 5767 - protein, 9 aa, Homo sapiens
LPSPLRVPP

SEQ ID NO: 5768 - protein, 9 aa, Homo sapiens
ILLDWAANV

SEQ ID NO: 5769 - protein, 9 aa, Homo sapiens
LLDWAANVY

SEQ ID NO: 5770 - protein, 9 aa, Homo sapiens
LLDWAANVY

SEQ ID NO: 5771 - protein, 9 aa, Homo sapiens
KLSELHAYI

SEQ ID NO: 5772 - protein, 9 aa, Homo sapiens
ELHAYILRV

SEQ ID NO: 5773 - protein, 9 aa, Homo sapiens
VPASAPHPR

SEQ ID NO: 5774 - protein, 9 aa, Homo sapiens
HLTSKMVGD

SEQ ID NO: 5775 - protein, 9 aa, Homo sapiens
QPWGRFGAA

SEQ ID NO: 5776 - protein, 9 aa, Homo sapiens
ITLNNLALI

SEQ ID NO: 5777 - protein, 9 aa, Homo sapiens
DITLNNLAL

SEQ ID NO: 5778 - protein, 9 aa, Homo sapiens
AEQLPVPQG

SEQ ID NO: 5779 - protein, 9 aa, Homo sapiens
LPVPQGILF

SEQ ID NO: 5780 - protein, 9 aa, Homo sapiens
VVPYEPPEV

SEQ ID NO: 5781 - protein, 9 aa, Homo sapiens
LLDSNRLEA

SEQ ID NO: 5782 - protein, 9 aa, Homo sapiens
MAGPQPLAL

SEQ ID NO: 5783 - protein, 9 aa, Homo sapiens
MAGPQPLAL

SEQ ID NO: 5784 - protein, 9 aa, Homo sapiens
ILGSRTAGP

SEQ ID NO: 5785 - protein, 9 aa, Homo sapiens
MERRMKAGY

SEQ ID NO: 5786 - protein, 9 aa, Homo sapiens
LLFALYFSA

SEQ ID NO: 5787 - protein, 9 aa, Homo sapiens
LLLNCCVCA

SEQ ID NO: 5788 - protein, 9 aa, Homo sapiens
LLNCCVCAA

SEQ ID NO: 5789 - protein, 9 aa, Homo sapiens
PEPCLPRQY

SEQ ID NO: 5790 - protein, 9 aa, Homo sapiens
SLPPAAAAA

SEQ ID NO: 5791 - protein, 9 aa, Homo sapiens
NPMNSLPPA

SEQ ID NO: 5792 - protein, 9 aa, Homo sapiens
LPPAAAAAA

SEQ ID NO: 5793 - protein, 9 aa, Homo sapiens
PPAAAAAAA

SEQ ID NO: 5794 - protein, 9 aa, Homo sapiens
AAAAAAASF

SEQ ID NO: 5795 - protein, 9 aa, Homo sapiens
WLAGSPLSF

SEQ ID NO: 5796 - protein, 9 aa, Homo sapiens
LSFQALLTL

SEQ ID NO: 5797 - protein, 9 aa, Homo sapiens
ITKNRNGLY

SEQ ID NO: 5798 - protein, 9 aa, Homo sapiens
YARLGSHLV

SEQ ID NO: 5799 - protein, 9 aa, Homo sapiens
ARLGSHLVL

SEQ ID NO: 5800 - protein, 9 aa, Homo sapiens
ELAYHYARL

SEQ ID NO: 5801 - protein, 9 aa, Homo sapiens
EELAYHYAR

SEQ ID NO: 5802 - protein, 9 aa, Homo sapiens
FPSVRDLAQ

SEQ ID NO: 5803 - protein, 9 aa, Homo sapiens
ALDGDAVVL

SEQ ID NO: 5804 - protein, 9 aa, Homo sapiens
ALDGDAVVL

SEQ ID NO: 5805 - protein, 9 aa, Homo sapiens
FLPDLNANA

SEQ ID NO: 5806 - protein, 9 aa, Homo sapiens
LPDLNANAA

SEQ ID NO: 5807 - protein, 9 aa, Homo sapiens
LPIDTQYYL

SEQ ID NO: 5808 - protein, 9 aa, Homo sapiens
SPSDLEAHF

SEQ ID NO: 5809 - protein, 9 aa, Homo sapiens
KAFSRISYL

SEQ ID NO: 5810 - protein, 9 aa, Homo sapiens
PLGIRLPHV

SEQ ID NO: 5811 - protein, 9 aa, Homo sapiens
RLPHVEYEL

SEQ ID NO: 5812 - protein, 9 aa, Homo sapiens
LPLGIRLPH

SEQ ID NO: 5813 - protein, 9 aa, Homo sapiens
GLGTGTAAL

SEQ ID NO: 5814 - protein, 9 aa, Homo sapiens
YADHMGLTR

SEQ ID NO: 5815 - protein, 9 aa, Homo sapiens
KILGETSLM

SEQ ID NO: 5816 - protein, 9 aa, Homo sapiens
ITDFGHSKI

SEQ ID NO: 5817 - protein, 9 aa, Homo sapiens
RLLSPACPA

SEQ ID NO: 5818 - protein, 9 aa, Homo sapiens
RQLGITNVL

SEQ ID NO: 5819 - protein, 9 aa, Homo sapiens
SGSDHLAFV

SEQ ID NO: 5820 - protein, 9 aa, Homo sapiens
DSGSDHLAF

SEQ ID NO: 5821 - protein, 9 aa, Homo sapiens
LPPRSLQVL

SEQ ID NO: 5822 - protein, 9 aa, Homo sapiens
LPVTGLSSA

SEQ ID NO: 5823 - protein, 9 aa, Homo sapiens
HPAGTCPAA

SEQ ID NO: 5824 - protein, 9 aa, Homo sapiens
DGIGVVPPV

SEQ ID NO: 5825 - protein, 9 aa, Homo sapiens
EVDDGIGVV

SEQ ID NO: 5826 - protein, 9 aa, Homo sapiens
FIFAFKGKY

SEQ ID NO: 5827 - protein, 9 aa, Homo sapiens
FIFAFKGKY

SEQ ID NO: 5828 - protein, 9 aa, Homo sapiens
VLLHRAFLV

SEQ ID NO: 5829 - protein, 9 aa, Homo sapiens
AAVLLHRAF

SEQ ID NO: 5830 - protein, 9 aa, Homo sapiens
SSSTEDFCY

SEQ ID NO: 5831 - protein, 9 aa, Homo sapiens
STEDFCYVF

SEQ ID NO: 5832 - protein, 9 aa, Homo sapiens
RLLPSIGLS

SEQ ID NO: 5833 - protein, 9 aa, Homo sapiens
LPSIGLSTV

SEQ ID NO: 5834 - protein, 9 aa, Homo sapiens
MGGAMAPPM

SEQ ID NO: 5835 - protein, 9 aa, Homo sapiens
CPFGGAFAL

SEQ ID NO: 5836 - protein, 9 aa, Homo sapiens
SLVPPAEEL

SEQ ID NO: 5837 - protein, 9 aa, Homo sapiens
LVPPAEELY

SEQ ID NO: 5838 - protein, 9 aa, Homo sapiens
PPAEELYQY

SEQ ID NO: 5839 - protein, 9 aa, Homo sapiens
PAGPKPGVI

SEQ ID NO: 5840 - protein, 9 aa, Homo sapiens
GLSEVRAAL

SEQ ID NO: 5841 - protein, 9 aa, Homo sapiens
RAALGLALY

SEQ ID NO: 5842 - protein, 9 aa, Homo sapiens
SEVRAALGL

SEQ ID NO: 5843 - protein, 9 aa, Homo sapiens
TLALAAAAA

SEQ ID NO: 5844 - protein, 9 aa, Homo sapiens
ALAAAAATA

SEQ ID NO: 5845 - protein, 9 aa, Homo sapiens
VPITLALAA

SEQ ID NO: 5846 - protein, 9 aa, Homo sapiens
LALAAAAAT

SEQ ID NO: 5847 - protein, 9 aa, Homo sapiens
LAAAAATAS

SEQ ID NO: 5848 - protein, 9 aa, Homo sapiens
AAAATASSL

SEQ ID NO: 5849 - protein, 9 aa, Homo sapiens
ISQQRLSLY

SEQ ID NO: 5850 - protein, 9 aa, Homo sapiens
AEWISQQRL

SEQ ID NO: 5851 - protein, 9 aa, Homo sapiens
NPLSACSIM

SEQ ID NO: 5852 - protein, 9 aa, Homo sapiens
VPNIKQNHY

SEQ ID NO: 5853 - protein, 9 aa, Homo sapiens
DVAKFTSSP

SEQ ID NO: 5854 - protein, 9 aa, Homo sapiens
TSSQPSVAY

SEQ ID NO: 5855 - protein, 9 aa, Homo sapiens
KVLVQLESL

SEQ ID NO: 5856 - protein, 9 aa, Homo sapiens
FMSAYSGVL

SEQ ID NO: 5857 - protein, 9 aa, Homo sapiens
SLCTFMSAY

SEQ ID NO: 5858 - protein, 9 aa, Homo sapiens
FMSAYSGVL

SEQ ID NO: 5859 - protein, 9 aa, Homo sapiens
VTGWLASGK

SEQ ID NO: 5860 - protein, 9 aa, Homo sapiens
TSDILKVPK

SEQ ID NO: 5861 - protein, 9 aa, Homo sapiens
SVDPATCPI

SEQ ID NO: 5862 - protein, 9 aa, Homo sapiens
FEIFFGRRM

SEQ ID NO: 5863 - protein, 9 aa, Homo sapiens
SGVFRLTVR

SEQ ID NO: 5864 - protein, 9 aa, Homo sapiens
KPLQVNITL

SEQ ID NO: 5865 - protein, 9 aa, Homo sapiens
LDANQDEQV

SEQ ID NO: 5866 - protein, 9 aa, Homo sapiens
SLACKDTSA

SEQ ID NO: 5867 - protein, 9 aa, Homo sapiens
DTWFMLARI

SEQ ID NO: 5868 - protein, 9 aa, Homo sapiens
SSDTWFMLA

SEQ ID NO: 5869 - protein, 9 aa, Homo sapiens
SDTWFMLAR

SEQ ID NO: 5870 - protein, 9 aa, Homo sapiens
TKSSDTWFM

SEQ ID NO: 5871 - protein, 9 aa, Homo sapiens
RTVGQAFEV

SEQ ID NO: 5872 - protein, 9 aa, Homo sapiens
STWDAWNER

SEQ ID NO: 5873 - protein, 9 aa, Homo sapiens
LLGDDDAYL

SEQ ID NO: 5874 - protein, 9 aa, Homo sapiens
IQSFYRMHR

SEQ ID NO: 5875 - protein, 9 aa, Homo sapiens
SFYRMHRAK

SEQ ID NO: 5876 - protein, 9 aa, Homo sapiens
LECPALPMI

SEQ ID NO: 5877 - protein, 9 aa, Homo sapiens
LILPPDHPV

SEQ ID NO: 5878 - protein, 9 aa, Homo sapiens
NEAPLILPP

SEQ ID NO: 5879 - protein, 9 aa, Homo sapiens
FHTANQRLQ

SEQ ID NO: 5880 - protein, 9 aa, Homo sapiens
KMSLANIYL

SEQ ID NO: 5881 - protein, 9 aa, Homo sapiens
FNMSDKYPI

SEQ ID NO: 5882 - protein, 9 aa, Homo sapiens
STLSFNMSD

SEQ ID NO: 5883 - protein, 9 aa, Homo sapiens
TLSFNMSDK

SEQ ID NO: 5884 - protein, 9 aa, Homo sapiens
LSFNMSDKY

SEQ ID NO: 5885 - protein, 9 aa, Homo sapiens
KQNRLRALK

SEQ ID NO: 5886 - protein, 9 aa, Homo sapiens
GLQSCQMLV

SEQ ID NO: 5887 - protein, 9 aa, Homo sapiens
QSCQMLVSK

SEQ ID NO: 5888 - protein, 9 aa, Homo sapiens
CASPHPRCL

SEQ ID NO: 5889 - protein, 9 aa, Homo sapiens
SNHDRIQRL

SEQ ID NO: 5890 - protein, 9 aa, Homo sapiens
RVIGMPPPV

SEQ ID NO: 5891 - protein, 9 aa, Homo sapiens
GHPVRLECR

SEQ ID NO: 5892 - protein, 9 aa, Homo sapiens
ASVETGFAK

SEQ ID NO: 5893 - protein, 9 aa, Homo sapiens
SVETGFAKK

SEQ ID NO: 5894 - protein, 9 aa, Homo sapiens
SHLDSGDYI

SEQ ID NO: 5895 - protein, 9 aa, Homo sapiens
RLKEAFDYI

SEQ ID NO: 5896 - protein, 9 aa, Homo sapiens
KSASTTAPK

SEQ ID NO: 5897 - protein, 9 aa, Homo sapiens
LEAARLLTY

SEQ ID NO: 5898 - protein, 9 aa, Homo sapiens
ILIVMVPFL

SEQ ID NO: 5899 - protein, 9 aa, Homo sapiens
LIVMVPFLL

SEQ ID NO: 5900 - protein, 9 aa, Homo sapiens
IVMVPFLLI

SEQ ID NO: 5901 - protein, 9 aa, Homo sapiens
VMVPFLLIL

SEQ ID NO: 5902 - protein, 9 aa, Homo sapiens
HLNHYNSYK

SEQ ID NO: 5903 - protein, 9 aa, Homo sapiens
IEHEHLNHY

SEQ ID NO: 5904 - protein, 9 aa, Homo sapiens
AICKPLHYL

SEQ ID NO: 5905 - protein, 9 aa, Homo sapiens
ILIFSGCNL

SEQ ID NO: 5906 - protein, 9 aa, Homo sapiens
LIFSGCNLL

SEQ ID NO: 5907 - protein, 9 aa, Homo sapiens
FLFTFFASI

SEQ ID NO: 5908 - protein, 9 aa, Homo sapiens
FASIDCYLL

SEQ ID NO: 5909 - protein, 9 aa, Homo sapiens
SIDCYLLAI

SEQ ID NO: 5910 - protein, 9 aa, Homo sapiens
FFLFTFFAS

SEQ ID NO: 5911 - protein, 9 aa, Homo sapiens
ARSEHGRYL

SEQ ID NO: 5912 - protein, 9 aa, Homo sapiens
RLREAVEAA

SEQ ID NO: 5913 - protein, 9 aa, Homo sapiens
YVNELVVFV

SEQ ID NO: 5914 - protein, 9 aa, Homo sapiens
QHAIQVQHI

SEQ ID NO: 5915 - protein, 9 aa, Homo sapiens
SSPLSHRSK

SEQ ID NO: 5916 - protein, 9 aa, Homo sapiens
RRFRDLNHY

SEQ ID NO: 5917 - protein, 9 aa, Homo sapiens
VVGAGGVGK

SEQ ID NO: 5918 - protein, 9 aa, Homo sapiens
AGTIRTCQK

SEQ ID NO: 5919 - protein, 9 aa, Homo sapiens
YVPTISHPM

SEQ ID NO: 5920 - protein, 9 aa, Homo sapiens
ALSKVVIRR

SEQ ID NO: 5921 - protein, 9 aa, Homo sapiens
KRTALSKVV

SEQ ID NO: 5922 - protein, 9 aa, Homo sapiens
YESSDRITL

SEQ ID NO: 5923 - protein, 9 aa, Homo sapiens
RHHESDPSL

SEQ ID NO: 5924 - protein, 9 aa, Homo sapiens
QVYIPNYNK

SEQ ID NO: 5925 - protein, 9 aa, Homo sapiens
ASNAPSAAK

SEQ ID NO: 5926 - protein, 9 aa, Homo sapiens
HLSPTAAEA

SEQ ID NO: 5927 - protein, 9 aa, Homo sapiens
TSLTFPGSR

SEQ ID NO: 5928 - protein, 9 aa, Homo sapiens
KEVKTSLTF

SEQ ID NO: 5929 - protein, 9 aa, Homo sapiens
WEHGDGYPF

SEQ ID NO: 5930 - protein, 9 aa, Homo sapiens
KRFSGCTLT

SEQ ID NO: 5931 - protein, 9 aa, Homo sapiens
FEGFLAKRF

SEQ ID NO: 5932 - protein, 9 aa, Homo sapiens
SVSENQSLL

SEQ ID NO: 5933 - protein, 9 aa, Homo sapiens
RLHDLVLPL

SEQ ID NO: 5934 - protein, 9 aa, Homo sapiens
LVLPLVMGV

SEQ ID NO: 5935 - protein, 9 aa, Homo sapiens
ILIAQVLGL

SEQ ID NO: 5936 - protein, 9 aa, Homo sapiens
RRCPHHERC

SEQ ID NO: 5937 - protein, 9 aa, Homo sapiens
GVLVASSHK

SEQ ID NO: 5938 - protein, 9 aa, Homo sapiens
YQSSSSTSA

SEQ ID NO: 5939 - protein, 9 aa, Homo sapiens
SALSNGFYH

SEQ ID NO: 5940 - protein, 9 aa, Homo sapiens
TLTEKLVAM

SEQ ID NO: 5941 - protein, 9 aa, Homo sapiens
AMTMGSGAK

SEQ ID NO: 5942 - protein, 9 aa, Homo sapiens
TEKLVAMTM

SEQ ID NO: 5943 - protein, 9 aa, Homo sapiens
YLSNSSVAK

SEQ ID NO: 5944 - protein, 9 aa, Homo sapiens
KTEELNREV

SEQ ID NO: 5945 - protein, 9 aa, Homo sapiens
FGDSACFTL

SEQ ID NO: 5946 - protein, 9 aa, Homo sapiens
TEFGDSACF

SEQ ID NO: 5947 - protein, 9 aa, Homo sapiens
GPAHLTTSK

SEQ ID NO: 5948 - protein, 9 aa, Homo sapiens
QLDGSSSSA

SEQ ID NO: 5949 - protein, 9 aa, Homo sapiens
MVVWLSWMI

SEQ ID NO: 5950 - protein, 9 aa, Homo sapiens
LMVVWLSWM

SEQ ID NO: 5951 - protein, 9 aa, Homo sapiens
VVWLSWMIK

SEQ ID NO: 5952 - protein, 9 aa, Homo sapiens
ALAILECAV

SEQ ID NO: 5953 - protein, 9 aa, Homo sapiens
ILECAVKPV

SEQ ID NO: 5954 - protein, 9 aa, Homo sapiens
LAILECAVK

SEQ ID NO: 5955 - protein, 9 aa, Homo sapiens
LECAVKPVV

SEQ ID NO: 5956 - protein, 9 aa, Homo sapiens
TMRWKLLPH

SEQ ID NO: 5957 - protein, 9 aa, Homo sapiens
EQEEEVTMV

SEQ ID NO: 5958 - protein, 9 aa, Homo sapiens
LIHPEYSAV

SEQ ID NO: 5959 - protein, 9 aa, Homo sapiens
KQFFYNLIH

SEQ ID NO: 5960 - protein, 9 aa, Homo sapiens
RVDAVCTHR

SEQ ID NO: 5961 - protein, 9 aa, Homo sapiens
SLFYGTAFG

SEQ ID NO: 5962 - protein, 9 aa, Homo sapiens
FGVYISSAV

SEQ ID NO: 5963 - protein, 9 aa, Homo sapiens
TTHKKIHTG

SEQ ID NO: 5964 - protein, 9 aa, Homo sapiens
IHTGEQPYI

SEQ ID NO: 5965 - protein, 9 aa, Homo sapiens
LLLYDLAQT

SEQ ID NO: 5966 - protein, 9 aa, Homo sapiens
LVKALLLYD

SEQ ID NO: 5967 - protein, 9 aa, Homo sapiens
KTLKVVVAV

SEQ ID NO: 5968 - protein, 9 aa, Homo sapiens
SQKGYHHFV

SEQ ID NO: 5969 - protein, 9 aa, Homo sapiens
GYHHFVLMK

SEQ ID NO: 5970 - protein, 9 aa, Homo sapiens
MDFELDIEF

SEQ ID NO: 5971 - protein, 9 aa, Homo sapiens
FELDIEFES

SEQ ID NO: 5972 - protein, 9 aa, Homo sapiens
NYMDFELDI

SEQ ID NO: 5973 - protein, 9 aa, Homo sapiens
RQLDLCVNR

SEQ ID NO: 5974 - protein, 9 aa, Homo sapiens
QLDLCVNRL

SEQ ID NO: 5975 - protein, 9 aa, Homo sapiens
LRSVYNPRI

SEQ ID NO: 5976 - protein, 9 aa, Homo sapiens
GICNLRGSK

SEQ ID NO: 5977 - protein, 9 aa, Homo sapiens
KQPPHQVEV

SEQ ID NO: 5978 - protein, 9 aa, Homo sapiens
SRGPPNHHM

SEQ ID NO: 5979 - protein, 9 aa, Homo sapiens
LRNKTSGVV

SEQ ID NO: 5980 - protein, 9 aa, Homo sapiens
LRLKERHGL

SEQ ID NO: 5981 - protein, 9 aa, Homo sapiens
EMIETSFSQ

SEQ ID NO: 5982 - protein, 9 aa, Homo sapiens
TSFSQNIPK

SEQ ID NO: 5983 - protein, 9 aa, Homo sapiens
KVIVATPKV

SEQ ID NO: 5984 - protein, 9 aa, Homo sapiens
SGMFRNGLE

SEQ ID NO: 5985 - protein, 9 aa, Homo sapiens
FRNGLEDGY

SEQ ID NO: 5986 - protein, 9 aa, Homo sapiens
WVLVVVGGV

SEQ ID NO: 5987 - protein, 9 aa, Homo sapiens
TEILLTPAR

SEQ ID NO: 5988 - protein, 9 aa, Homo sapiens
VLNHFFCDI

SEQ ID NO: 5989 - protein, 9 aa, Homo sapiens
FFCDISPIL

SEQ ID NO: 5990 - protein, 9 aa, Homo sapiens
EVNPWKREV

SEQ ID NO: 5991 - protein, 9 aa, Homo sapiens
QAIKGAFYR

SEQ ID NO: 5992 - protein, 9 aa, Homo sapiens
AIKGAFYRR

SEQ ID NO: 5993 - protein, 9 aa, Homo sapiens
GAFYRRAQR

SEQ ID NO: 5994 - protein, 9 aa, Homo sapiens
AFYRRAQRL

SEQ ID NO: 5995 - protein, 9 aa, Homo sapiens
EELETGPEQ

SEQ ID NO: 5996 - protein, 9 aa, Homo sapiens
IRRVRAQEI

SEQ ID NO: 5997 - protein, 9 aa, Homo sapiens
AAMSASSEG

SEQ ID NO: 5998 - protein, 9 aa, Homo sapiens
FMIGTIMAK

SEQ ID NO: 5999 - protein, 9 aa, Homo sapiens
GTIMAKMAR

SEQ ID NO: 6000 - protein, 9 aa, Homo sapiens
IMAKMARPK

SEQ ID NO: 6001 - protein, 9 aa, Homo sapiens
VMAAVQNPA

SEQ ID NO: 6002 - protein, 9 aa, Homo sapiens
ELPPLTPVL

SEQ ID NO: 6003 - protein, 9 aa, Homo sapiens
ATSGRGLAK

SEQ ID NO: 6004 - protein, 9 aa, Homo sapiens
YMGDGELCQ

SEQ ID NO: 6005 - protein, 9 aa, Homo sapiens
ALGQAITLH

SEQ ID NO: 6006 - protein, 9 aa, Homo sapiens
GMRPEVTLA

SEQ ID NO: 6007 - protein, 9 aa, Homo sapiens
VIFSAIHVL

SEQ ID NO: 6008 - protein, 9 aa, Homo sapiens
SAIHVLASL

SEQ ID NO: 6009 - protein, 9 aa, Homo sapiens
VLASLALST

SEQ ID NO: 6010 - protein, 9 aa, Homo sapiens
IHVLASLAL

SEQ ID NO: 6011 - protein, 9 aa, Homo sapiens
TLVMFYAPW

SEQ ID NO: 6012 - protein, 9 aa, Homo sapiens
VVAAAAAAK

SEQ ID NO: 6013 - protein, 9 aa, Homo sapiens
AAAAKTTSK

SEQ ID NO: 6014 - protein, 9 aa, Homo sapiens
ALDANETRL

SEQ ID NO: 6015 - protein, 9 aa, Homo sapiens
NETRLLTGS

SEQ ID NO: 6016 - protein, 9 aa, Homo sapiens
MALDANETR

SEQ ID NO: 6017 - protein, 9 aa, Homo sapiens
HTAYISELK

SEQ ID NO: 6018 - protein, 9 aa, Homo sapiens
RHTAYISEL

SEQ ID NO: 6019 - protein, 9 aa, Homo sapiens
VQYLGMLPV

SEQ ID NO: 6020 - protein, 9 aa, Homo sapiens
GMLPVDKPV

SEQ ID NO: 6021 - protein, 9 aa, Homo sapiens
FHVQYLGML

SEQ ID NO: 6022 - protein, 9 aa, Homo sapiens
DEQNCTLEI

SEQ ID NO: 6023 - protein, 9 aa, Homo sapiens
IMDFHYNEK

SEQ ID NO: 6024 - protein, 9 aa, Homo sapiens
ISFCQYFLL

SEQ ID NO: 6025 - protein, 9 aa, Homo sapiens
AVHQISFCQ

SEQ ID NO: 6026 - protein, 9 aa, Homo sapiens
QYFLLDIAF

SEQ ID NO: 6027 - protein, 9 aa, Homo sapiens
NLFSQDISV

SEQ ID NO: 6028 - protein, 9 aa, Homo sapiens
FSQDISVKM

SEQ ID NO: 6029 - protein, 9 aa, Homo sapiens
DQCSGHGTY

SEQ ID NO: 6030 - protein, 9 aa, Homo sapiens
IQLHSSQVL

SEQ ID NO: 6031 - protein, 9 aa, Homo sapiens
ISQRVAAEN

SEQ ID NO: 6032 - protein, 9 aa, Homo sapiens
FLHEIFHQG

SEQ ID NO: 6033 - protein, 9 aa, Homo sapiens
LHEIFHQGL

SEQ ID NO: 6034 - protein, 9 aa, Homo sapiens
FHQGLKARI

SEQ ID NO: 6035 - protein, 9 aa, Homo sapiens
SKKSEDLSL

SEQ ID NO: 6036 - protein, 9 aa, Homo sapiens
GVCGFDLHE

SEQ ID NO: 6037 - protein, 9 aa, Homo sapiens
GSNINKSLT

SEQ ID NO: 6038 - protein, 9 aa, Homo sapiens
STMVVYIPT

SEQ ID NO: 6039 - protein, 9 aa, Homo sapiens
ESYSIYVYK

SEQ ID NO: 6040 - protein, 9 aa, Homo sapiens
KESYSIYVY

SEQ ID NO: 6041 - protein, 9 aa, Homo sapiens
KQSASAVQV

SEQ ID NO: 6042 - protein, 9 aa, Homo sapiens
VQVPVSVAM

SEQ ID NO: 6043 - protein, 9 aa, Homo sapiens
MLRIVEPYV

SEQ ID NO: 6044 - protein, 9 aa, Homo sapiens
KMLRIVEPY

SEQ ID NO: 6045 - protein, 9 aa, Homo sapiens
VEPYVTWGF

SEQ ID NO: 6046 - protein, 9 aa, Homo sapiens
ATMGNSYGR

SEQ ID NO: 6047 - protein, 9 aa, Homo sapiens
TRKRGAEIL

SEQ ID NO: 6048 - protein, 9 aa, Homo sapiens
IAEKTEFFK

SEQ ID NO: 6049 - protein, 9 aa, Homo sapiens
LHTVCHPNT

SEQ ID NO: 6050 - protein, 9 aa, Homo sapiens
FFIPLMFMI

SEQ ID NO: 6051 - protein, 9 aa, Homo sapiens
CRIELYRVV

SEQ ID NO: 6052 - protein, 9 aa, Homo sapiens
RIFSSSDVA

SEQ ID NO: 6053 - protein, 9 aa, Homo sapiens
FSSSDVAFI

SEQ ID NO: 6054 - protein, 9 aa, Homo sapiens
SSDVAFISY

SEQ ID NO: 6055 - protein, 9 aa, Homo sapiens
SRIFSSSDV

SEQ ID NO: 6056 - protein, 9 aa, Homo sapiens
FSSSDVAFI

SEQ ID NO: 6057 - protein, 9 aa, Homo sapiens
HIILFQPQK

SEQ ID NO: 6058 - protein, 9 aa, Homo sapiens
LRRTTDPKL

SEQ ID NO: 6059 - protein, 9 aa, Homo sapiens
DEISKLSQL

SEQ ID NO: 6060 - protein, 9 aa, Homo sapiens
YWDIQVFYR

SEQ ID NO: 6061 - protein, 9 aa, Homo sapiens
LELERAYSE

SEQ ID NO: 6062 - protein, 9 aa, Homo sapiens
NHPVCKEYL

SEQ ID NO: 6063 - protein, 9 aa, Homo sapiens
TNTDQLFTV

SEQ ID NO: 6064 - protein, 9 aa, Homo sapiens
GLLGGWTVL

SEQ ID NO: 6065 - protein, 9 aa, Homo sapiens
LLGGWTVLL

SEQ ID NO: 6066 - protein, 9 aa, Homo sapiens
GGWTVLLLL

SEQ ID NO: 6067 - protein, 9 aa, Homo sapiens
LHNVGLLGG

SEQ ID NO: 6068 - protein, 9 aa, Homo sapiens
GLLGGWTVL

SEQ ID NO: 6069 - protein, 9 aa, Homo sapiens
LLGGWTVLL

SEQ ID NO: 6070 - protein, 9 aa, Homo sapiens
RRFLEELGY

SEQ ID NO: 6071 - protein, 9 aa, Homo sapiens
TRLPAHGQM

SEQ ID NO: 6072 - protein, 9 aa, Homo sapiens
LLVGAKYGI

SEQ ID NO: 6073 - protein, 9 aa, Homo sapiens
YIALLVGAK

SEQ ID NO: 6074 - protein, 9 aa, Homo sapiens
RESYIALLV

SEQ ID NO: 6075 - protein, 9 aa, Homo sapiens
GEDKVSVTF

SEQ ID NO: 6076 - protein, 9 aa, Homo sapiens
RRWGLPRRI

SEQ ID NO: 6077 - protein, 9 aa, Homo sapiens
RRIHESLSL

SEQ ID NO: 6078 - protein, 9 aa, Homo sapiens
SGGQDLLLY

SEQ ID NO: 6079 - protein, 9 aa, Homo sapiens
ALFSELSPV

SEQ ID NO: 6080 - protein, 9 aa, Homo sapiens
TVAPLSVPR

SEQ ID NO: 6081 - protein, 9 aa, Homo sapiens
IRRRNLRKI

SEQ ID NO: 6082 - protein, 9 aa, Homo sapiens
FRGPQARVV

SEQ ID NO: 6083 - protein, 9 aa, Homo sapiens
MGNPCEFFV

SEQ ID NO: 6084 - protein, 9 aa, Homo sapiens
NPCEFFVDI

SEQ ID NO: 6085 - protein, 9 aa, Homo sapiens
PEMVGHPAF

SEQ ID NO: 6086 - protein, 9 aa, Homo sapiens
ATFMDGKLM

SEQ ID NO: 6087 - protein, 9 aa, Homo sapiens
FMDGKLMLL

SEQ ID NO: 6088 - protein, 9 aa, Homo sapiens
MLLLWSCTV

SEQ ID NO: 6089 - protein, 9 aa, Homo sapiens
SPQEDKEVI

SEQ ID NO: 6090 - protein, 9 aa, Homo sapiens
RLVQALPTV

SEQ ID NO: 6091 - protein, 9 aa, Homo sapiens
MVQHFKVTI

SEQ ID NO: 6092 - protein, 9 aa, Homo sapiens
EQRSFCSTV

SEQ ID NO: 6093 - protein, 9 aa, Homo sapiens
DPFAPGGTV

SEQ ID NO: 6094 - protein, 9 aa, Homo sapiens
FAPGGTVVA

SEQ ID NO: 6095 - protein, 9 aa, Homo sapiens
QMLAVSATY

SEQ ID NO: 6096 - protein, 9 aa, Homo sapiens
QMLAVSATY

SEQ ID NO: 6097 - protein, 9 aa, Homo sapiens
HMLMSQRVI

SEQ ID NO: 6098 - protein, 9 aa, Homo sapiens
APSLRWLFN

SEQ ID NO: 6099 - protein, 9 aa, Homo sapiens
ILLPGPRSL

SEQ ID NO: 6100 - protein, 9 aa, Homo sapiens
YINAKPNLF

SEQ ID NO: 6101 - protein, 9 aa, Homo sapiens
NAKPNLFSM

SEQ ID NO: 6102 - protein, 9 aa, Homo sapiens
SEVTRQSAL

SEQ ID NO: 6103 - protein, 9 aa, Homo sapiens
FISESQYTY

SEQ ID NO: 6104 - protein, 9 aa, Homo sapiens
FISESQYTY

SEQ ID NO: 6105 - protein, 9 aa, Homo sapiens
SESQYTYAL

SEQ ID NO: 6106 - protein, 9 aa, Homo sapiens
SQYTYALKE

SEQ ID NO: 6107 - protein, 9 aa, Homo sapiens
FISESQYTY

SEQ ID NO: 6108 - protein, 9 aa, Homo sapiens
LSRQHLEKY

SEQ ID NO: 6109 - protein, 9 aa, Homo sapiens
QARLSRQHL

SEQ ID NO: 6110 - protein, 9 aa, Homo sapiens
LSRQHLEKY

SEQ ID NO: 6111 - protein, 9 aa, Homo sapiens
VVITAIIFY

SEQ ID NO: 6112 - protein, 9 aa, Homo sapiens
VVVVITAII

SEQ ID NO: 6113 - protein, 9 aa, Homo sapiens
KAALLNQHY

SEQ ID NO: 6114 - protein, 9 aa, Homo sapiens
KAMESHKHY

SEQ ID NO: 6115 - protein, 9 aa, Homo sapiens
RSTNHDKVV

SEQ ID NO: 6116 - protein, 9 aa, Homo sapiens
AMYICCVLM

SEQ ID NO: 6117 - protein, 9 aa, Homo sapiens
NAMYICCVL

SEQ ID NO: 6118 - protein, 9 aa, Homo sapiens
YICCVLMLL

SEQ ID NO: 6119 - protein, 9 aa, Homo sapiens
WHDGVKRFF

SEQ ID NO: 6120 - protein, 9 aa, Homo sapiens
IGGDDLSTL

SEQ ID NO: 6121 - protein, 9 aa, Homo sapiens
QAQSVNKLV

SEQ ID NO: 6122 - protein, 9 aa, Homo sapiens
ITFDNWRLL

SEQ ID NO: 6123 - protein, 9 aa, Homo sapiens
TFDNWRLLH

SEQ ID NO: 6124 - protein, 9 aa, Homo sapiens
RLLHGRRSY

SEQ ID NO: 6125 - protein, 9 aa, Homo sapiens
ITFDNWRLL

SEQ ID NO: 6126 - protein, 9 aa, Homo sapiens
VHSEQVFAL

SEQ ID NO: 6127 - protein, 9 aa, Homo sapiens
FEGCMMQLF

SEQ ID NO: 6128 - protein, 9 aa, Homo sapiens
ASYSSSVTP

SEQ ID NO: 6129 - protein, 9 aa, Homo sapiens
YSSSVTPKM

SEQ ID NO: 6130 - protein, 9 aa, Homo sapiens
TAKELTPFL

SEQ ID NO: 6131 - protein, 9 aa, Homo sapiens
FPEHSQQLL

SEQ ID NO: 6132 - protein, 9 aa, Homo sapiens
QTDESTLMT

SEQ ID NO: 6133 - protein, 9 aa, Homo sapiens
YNIPQTDES

SEQ ID NO: 6134 - protein, 9 aa, Homo sapiens
STLMTIAYV

SEQ ID NO: 6135 - protein, 9 aa, Homo sapiens
FLDQDQSPP

SEQ ID NO: 6136 - protein, 9 aa, Homo sapiens
LAAATLGVL

SEQ ID NO: 6137 - protein, 9 aa, Homo sapiens
GVLCLGLVV

SEQ ID NO: 6138 - protein, 9 aa, Homo sapiens
LCLGLVVTI

SEQ ID NO: 6139 - protein, 9 aa, Homo sapiens
KQSEHRPSL

SEQ ID NO: 6140 - protein, 9 aa, Homo sapiens
RPFLVSIML

SEQ ID NO: 6141 - protein, 9 aa, Homo sapiens
IMLRSIYTI

SEQ ID NO: 6142 - protein, 9 aa, Homo sapiens
FLLNGRSVL

SEQ ID NO: 6143 - protein, 9 aa, Homo sapiens
FLLNGRSVL

SEQ ID NO: 6144 - protein, 9 aa, Homo sapiens
FSLCYWNPY

SEQ ID NO: 6145 - protein, 9 aa, Homo sapiens
RCKDFSLCY

SEQ ID NO: 6146 - protein, 9 aa, Homo sapiens
FSLCYWNPY

SEQ ID NO: 6147 - protein, 9 aa, Homo sapiens
LCYWNPYWM

SEQ ID NO: 6148 - protein, 9 aa, Homo sapiens
FSLCYWNPY

SEQ ID NO: 6149 - protein, 9 aa, Homo sapiens
CYWNPYWML

SEQ ID NO: 6150 - protein, 9 aa, Homo sapiens
LNDEIINFY

SEQ ID NO: 6151 - protein, 9 aa, Homo sapiens
KTHSGALMY

SEQ ID NO: 6152 - protein, 9 aa, Homo sapiens
KTHSGALMY

SEQ ID NO: 6153 - protein, 9 aa, Homo sapiens
TIMKFLKMG

SEQ ID NO: 6154 - protein, 9 aa, Homo sapiens
MKFLKMGNI

SEQ ID NO: 6155 - protein, 9 aa, Homo sapiens
VVRELMLRY

SEQ ID NO: 6156 - protein, 9 aa, Homo sapiens
KALGLVIRL

SEQ ID NO: 6157 - protein, 9 aa, Homo sapiens
FEEVPDYMY

SEQ ID NO: 6158 - protein, 9 aa, Homo sapiens
FEEVPDYMY

SEQ ID NO: 6159 - protein, 9 aa, Homo sapiens
PTQADCFTY

SEQ ID NO: 6160 - protein, 9 aa, Homo sapiens
MMLIGTPTQ

SEQ ID NO: 6161 - protein, 9 aa, Homo sapiens
PTQADCFTY

SEQ ID NO: 6162 - protein, 9 aa, Homo sapiens
YVLDSTDEA

SEQ ID NO: 6163 - protein, 9 aa, Homo sapiens
FTEEKEAFI

SEQ ID NO: 6164 - protein, 9 aa, Homo sapiens
TVLEKLRPL

SEQ ID NO: 6165 - protein, 9 aa, Homo sapiens
RPLDQKLKY

SEQ ID NO: 6166 - protein, 9 aa, Homo sapiens
ELRENSIAV

SEQ ID NO: 6167 - protein, 9 aa, Homo sapiens
FIFHNTTPS

SEQ ID NO: 6168 - protein, 9 aa, Homo sapiens
SADFQAKEI

SEQ ID NO: 6169 - protein, 9 aa, Homo sapiens
QAKEIFSTC

SEQ ID NO: 6170 - protein, 9 aa, Homo sapiens
TSGNIPPNY

SEQ ID NO: 6171 - protein, 9 aa, Homo sapiens
GNIPPNYQY

SEQ ID NO: 6172 - protein, 9 aa, Homo sapiens
NIPPNYQYI

SEQ ID NO: 6173 - protein, 9 aa, Homo sapiens
GSPEEASFY

SEQ ID NO: 6174 - protein, 9 aa, Homo sapiens
SPEEASFYY

SEQ ID NO: 6175 - protein, 9 aa, Homo sapiens
GSPEEASFY

SEQ ID NO: 6176 - protein, 9 aa, Homo sapiens
SPEEASFYY

SEQ ID NO: 6177 - protein, 9 aa, Homo sapiens
AGFWIIHPY

SEQ ID NO: 6178 - protein, 9 aa, Homo sapiens
GFWIIHPYS

SEQ ID NO: 6179 - protein, 9 aa, Homo sapiens
WIIHPYSDF

SEQ ID NO: 6180 - protein, 9 aa, Homo sapiens
HPYSDFRFY

SEQ ID NO: 6181 - protein, 9 aa, Homo sapiens
SAGFWIIHP

SEQ ID NO: 6182 - protein, 9 aa, Homo sapiens
HPYSDFRFY

SEQ ID NO: 6183 - protein, 9 aa, Homo sapiens
HINDIIKIQ

SEQ ID NO: 6184 - protein, 9 aa, Homo sapiens
QAFIRANKA

SEQ ID NO: 6185 - protein, 9 aa, Homo sapiens
EKDEGEIQY

SEQ ID NO: 6186 - protein, 9 aa, Homo sapiens
CRFGVALGL

SEQ ID NO: 6187 - protein, 9 aa, Homo sapiens
GACRFGVAL

SEQ ID NO: 6188 - protein, 9 aa, Homo sapiens
QSLLPQLLY

SEQ ID NO: 6189 - protein, 9 aa, Homo sapiens
QSLLPQLLY

SEQ ID NO: 6190 - protein, 9 aa, Homo sapiens
FDEDINDKI

SEQ ID NO: 6191 - protein, 9 aa, Homo sapiens
NRLSPDSPL

SEQ ID NO: 6192 - protein, 9 aa, Homo sapiens
KPGAHINAV

SEQ ID NO: 6193 - protein, 9 aa, Homo sapiens
AEAAMVHML

SEQ ID NO: 6194 - protein, 9 aa, Homo sapiens
PAEAAMVHM

SEQ ID NO: 6195 - protein, 9 aa, Homo sapiens
LSKGPGLEV

SEQ ID NO: 6196 - protein, 9 aa, Homo sapiens
LSFCANHEI

SEQ ID NO: 6197 - protein, 9 aa, Homo sapiens
CANHEIPHF

SEQ ID NO: 6198 - protein, 9 aa, Homo sapiens
AEIEALAAL

SEQ ID NO: 6199 - protein, 9 aa, Homo sapiens
LAALKMREL

SEQ ID NO: 6200 - protein, 9 aa, Homo sapiens
RMPEAAPPV

SEQ ID NO: 6201 - protein, 9 aa, Homo sapiens
SPSELSPRI

SEQ ID NO: 6202 - protein, 9 aa, Homo sapiens
MEHPKYEWF

SEQ ID NO: 6203 - protein, 9 aa, Homo sapiens
LGTGTSILS

SEQ ID NO: 6204 - protein, 9 aa, Homo sapiens
FSYMWTINN

SEQ ID NO: 6205 - protein, 9 aa, Homo sapiens
FCIARSLSI

SEQ ID NO: 6206 - protein, 9 aa, Homo sapiens
DRIKDNGVL

SEQ ID NO: 6207 - protein, 9 aa, Homo sapiens
SAMKNLLKY

SEQ ID NO: 6208 - protein, 9 aa, Homo sapiens
SAMKNLLKY

SEQ ID NO: 6209 - protein, 9 aa, Homo sapiens
LKYSSQALV

SEQ ID NO: 6210 - protein, 9 aa, Homo sapiens
SQKEFVRRY

SEQ ID NO: 6211 - protein, 9 aa, Homo sapiens
FPKTNLKPG

SEQ ID NO: 6212 - protein, 9 aa, Homo sapiens
LEKWRRPFY

SEQ ID NO: 6213 - protein, 9 aa, Homo sapiens
WRRPFYRVL

SEQ ID NO: 6214 - protein, 9 aa, Homo sapiens
CPRPQSCVV

SEQ ID NO: 6215 - protein, 9 aa, Homo sapiens
LPPDAFIHV

SEQ ID NO: 6216 - protein, 9 aa, Homo sapiens
DAFIHVDDF

SEQ ID NO: 6217 - protein, 9 aa, Homo sapiens
QPAVFGTTV

SEQ ID NO: 6218 - protein, 9 aa, Homo sapiens
DMDTNLEPV

SEQ ID NO: 6219 - protein, 9 aa, Homo sapiens
VTQNDIGFY

SEQ ID NO: 6220 - protein, 9 aa, Homo sapiens
VTQNDIGFY

SEQ ID NO: 6221 - protein, 9 aa, Homo sapiens
PTPPPTLHL

SEQ ID NO: 6222 - protein, 9 aa, Homo sapiens
VPDAAGTSL

SEQ ID NO: 6223 - protein, 9 aa, Homo sapiens
KAFRHRSNL

SEQ ID NO: 6224 - protein, 9 aa, Homo sapiens
LSGDSVKTI

SEQ ID NO: 6225 - protein, 9 aa, Homo sapiens
LLAHPGPLV

SEQ ID NO: 6226 - protein, 9 aa, Homo sapiens
DEDQAMRAF

SEQ ID NO: 6227 - protein, 9 aa, Homo sapiens
KMFMRGRPI

SEQ ID NO: 6228 - protein, 9 aa, Homo sapiens
FMRGRPITM

SEQ ID NO: 6229 - protein, 9 aa, Homo sapiens
LQIPPGPPK

SEQ ID NO: 6230 - protein, 9 aa, Homo sapiens
GTRRIGHPY

SEQ ID NO: 6231 - protein, 9 aa, Homo sapiens
SPFSGTRRI

SEQ ID NO: 6232 - protein, 9 aa, Homo sapiens
PSSPKVYLY

SEQ ID NO: 6233 - protein, 9 aa, Homo sapiens
FETENLDSI

SEQ ID NO: 6234 - protein, 9 aa, Homo sapiens
EEFLSFFDH

SEQ ID NO: 6235 - protein, 9 aa, Homo sapiens
FFDHSTRIV

SEQ ID NO: 6236 - protein, 9 aa, Homo sapiens
MAPASGPVF

SEQ ID NO: 6237 - protein, 9 aa, Homo sapiens
RAESCEFTV

SEQ ID NO: 6238 - protein, 9 aa, Homo sapiens
AEVVPVKVH

SEQ ID NO: 6239 - protein, 9 aa, Homo sapiens
RAEVVPVKV

SEQ ID NO: 6240 - protein, 9 aa, Homo sapiens
VMKQDSGQY

SEQ ID NO: 6241 - protein, 9 aa, Homo sapiens
RVMAWRRMV

SEQ ID NO: 6242 - protein, 9 aa, Homo sapiens
RATSARPSV

SEQ ID NO: 6243 - protein, 9 aa, Homo sapiens
DAHTCLSAL

SEQ ID NO: 6244 - protein, 9 aa, Homo sapiens
MLANNNLQI

SEQ ID NO: 6245 - protein, 9 aa, Homo sapiens
LANNNLQIL

SEQ ID NO: 6246 - protein, 9 aa, Homo sapiens
YTEEEPEWF

SEQ ID NO: 6247 - protein, 9 aa, Homo sapiens
RPAPARPTM

SEQ ID NO: 6248 - protein, 9 aa, Homo sapiens
PSLEIYKKM

SEQ ID NO: 6249 - protein, 9 aa, Homo sapiens
EIYKKMFEV

SEQ ID NO: 6250 - protein, 9 aa, Homo sapiens
SAFEAIIQY

SEQ ID NO: 6251 - protein, 9 aa, Homo sapiens
FIKITLSAF

SEQ ID NO: 6252 - protein, 9 aa, Homo sapiens
ITLSAFEAI

SEQ ID NO: 6253 - protein, 9 aa, Homo sapiens
SAFEAIIQY

SEQ ID NO: 6254 - protein, 9 aa, Homo sapiens
STLGIALKF

SEQ ID NO: 6255 - protein, 9 aa, Homo sapiens
TLGIALKFY

SEQ ID NO: 6256 - protein, 9 aa, Homo sapiens
GIALKFYNY

SEQ ID NO: 6257 - protein, 9 aa, Homo sapiens
FHPKECRVI

SEQ ID NO: 6258 - protein, 9 aa, Homo sapiens
IAVILANAV

SEQ ID NO: 6259 - protein, 9 aa, Homo sapiens
LANAVAQSL

SEQ ID NO: 6260 - protein, 9 aa, Homo sapiens
AEVDKCLAD

SEQ ID NO: 6261 - protein, 9 aa, Homo sapiens
VQYEGRQSI

SEQ ID NO: 6262 - protein, 9 aa, Homo sapiens
YEGRQSICV

SEQ ID NO: 6263 - protein, 9 aa, Homo sapiens
IERDEVRNV

SEQ ID NO: 6264 - protein, 9 aa, Homo sapiens
YEIRPGRLL

SEQ ID NO: 6265 - protein, 9 aa, Homo sapiens
YEIRPGRLL

SEQ ID NO: 6266 - protein, 9 aa, Homo sapiens
YIYVPDPDV

SEQ ID NO: 6267 - protein, 9 aa, Homo sapiens
YVPDPDVAF

SEQ ID NO: 6268 - protein, 9 aa, Homo sapiens
VPDPDVAFV

SEQ ID NO: 6269 - protein, 9 aa, Homo sapiens
GVYTRVTAY

SEQ ID NO: 6270 - protein, 9 aa, Homo sapiens
GVYTRVTAY

SEQ ID NO: 6271 - protein, 9 aa, Homo sapiens
FIHEYISGY

SEQ ID NO: 6272 - protein, 9 aa, Homo sapiens
SGYYRVSSY

SEQ ID NO: 6273 - protein, 9 aa, Homo sapiens
FIHEYISGY

SEQ ID NO: 6274 - protein, 9 aa, Homo sapiens
SGYYRVSSY

SEQ ID NO: 6275 - protein, 9 aa, Homo sapiens
EANDLALRL

SEQ ID NO: 6276 - protein, 9 aa, Homo sapiens
LALRLARQF

SEQ ID NO: 6277 - protein, 9 aa, Homo sapiens
GFMIQDGPF

SEQ ID NO: 6278 - protein, 9 aa, Homo sapiens
PFGSCENKY

SEQ ID NO: 6279 - protein, 9 aa, Homo sapiens
TNYMWNNHI

SEQ ID NO: 6280 - protein, 9 aa, Homo sapiens
WGIQLAAVY

SEQ ID NO: 6281 - protein, 9 aa, Homo sapiens
LSSSSTLTI

SEQ ID NO: 6282 - protein, 9 aa, Homo sapiens
RSGSRREKV

SEQ ID NO: 6283 - protein, 9 aa, Homo sapiens
QLMGNGFHF

SEQ ID NO: 6284 - protein, 9 aa, Homo sapiens
DVNDHAPEV

SEQ ID NO: 6285 - protein, 9 aa, Homo sapiens
QMHQLVAAY

SEQ ID NO: 6286 - protein, 9 aa, Homo sapiens
LASRTNEQM

SEQ ID NO: 6287 - protein, 9 aa, Homo sapiens
ELQPCVKTY

SEQ ID NO: 6288 - protein, 9 aa, Homo sapiens
YGLHEGRRV

SEQ ID NO: 6289 - protein, 9 aa, Homo sapiens
TRNGRSILL

SEQ ID NO: 6290 - protein, 9 aa, Homo sapiens
VTRNGRSIL

SEQ ID NO: 6291 - protein, 9 aa, Homo sapiens
YKMNSSIKL

SEQ ID NO: 6292 - protein, 9 aa, Homo sapiens
RIYKMNSSI

SEQ ID NO: 6293 - protein, 9 aa, Homo sapiens
YKMNSSIKL

SEQ ID NO: 6294 - protein, 9 aa, Homo sapiens
KVIESSPNY

SEQ ID NO: 6295 - protein, 9 aa, Homo sapiens
LSLPMYVVF

SEQ ID NO: 6296 - protein, 9 aa, Homo sapiens
VVFKRCLPL

SEQ ID NO: 6297 - protein, 9 aa, Homo sapiens
YPKLKLKIM

SEQ ID NO: 6298 - protein, 9 aa, Homo sapiens
AEIQEKWKS

SEQ ID NO: 6299 - protein, 9 aa, Homo sapiens
EHDFVIKKI

SEQ ID NO: 6300 - protein, 9 aa, Homo sapiens
IKKIPFKMV

SEQ ID NO: 6301 - protein, 9 aa, Homo sapiens
DEKPRFKSI

SEQ ID NO: 6302 - protein, 9 aa, Homo sapiens
FRAWKTKFI

SEQ ID NO: 6303 - protein, 9 aa, Homo sapiens
FPESSTPSI

SEQ ID NO: 6304 - protein, 9 aa, Homo sapiens
FPESSTPSI

SEQ ID NO: 6305 - protein, 9 aa, Homo sapiens
PAAKEVPRI

SEQ ID NO: 6306 - protein, 9 aa, Homo sapiens
AAKEVPRII

SEQ ID NO: 6307 - protein, 9 aa, Homo sapiens
TALHIAALY

SEQ ID NO: 6308 - protein, 9 aa, Homo sapiens
TALHIAALY

SEQ ID NO: 6309 - protein, 9 aa, Homo sapiens
TALHIAALY

SEQ ID NO: 6310 - protein, 9 aa, Homo sapiens
TALHIAALY

SEQ ID NO: 6311 - protein, 9 aa, Homo sapiens
MYFFLSHLA

SEQ ID NO: 6312 - protein, 9 aa, Homo sapiens
HLAIIDMSY

SEQ ID NO: 6313 - protein, 9 aa, Homo sapiens
PMYFFLSHL

SEQ ID NO: 6314 - protein, 9 aa, Homo sapiens
YFFLSHLAI

SEQ ID NO: 6315 - protein, 9 aa, Homo sapiens
FFLSHLAII

SEQ ID NO: 6316 - protein, 9 aa, Homo sapiens
LAQKCFKNC

SEQ ID NO: 6317 - protein, 9 aa, Homo sapiens
LLFGWGETY

SEQ ID NO: 6318 - protein, 9 aa, Homo sapiens
LLFGWGETY

SEQ ID NO: 6319 - protein, 9 aa, Homo sapiens
LPEPLLKSI

SEQ ID NO: 6320 - protein, 9 aa, Homo sapiens
SEMLVAYCM

SEQ ID NO: 6321 - protein, 9 aa, Homo sapiens
MLADSINRM

SEQ ID NO: 6322 - protein, 9 aa, Homo sapiens
KICDKPAKV

SEQ ID NO: 6323 - protein, 9 aa, Homo sapiens
RVKQRINTY

SEQ ID NO: 6324 - protein, 9 aa, Homo sapiens
FKGESSGRI

SEQ ID NO: 6325 - protein, 9 aa, Homo sapiens
FNPHVHVEY

SEQ ID NO: 6326 - protein, 9 aa, Homo sapiens
VHVEYEWNL

SEQ ID NO: 6327 - protein, 9 aa, Homo sapiens
LESFKIMDY

SEQ ID NO: 6328 - protein, 9 aa, Homo sapiens
FKIMDYSLL

SEQ ID NO: 6329 - protein, 9 aa, Homo sapiens
RVLESFKIM

SEQ ID NO: 6330 - protein, 9 aa, Homo sapiens
FSTVMSMLY

SEQ ID NO: 6331 - protein, 9 aa, Homo sapiens
STVMSMLYY

SEQ ID NO: 6332 - protein, 9 aa, Homo sapiens
FSTVMSMLY

SEQ ID NO: 6333 - protein, 9 aa, Homo sapiens
STVMSMLYY

SEQ ID NO: 6334 - protein, 9 aa, Homo sapiens
IVVFFSTVM

SEQ ID NO: 6335 - protein, 9 aa, Homo sapiens
RARDNNGSY

SEQ ID NO: 6336 - protein, 9 aa, Homo sapiens
DPRPIAASL

SEQ ID NO: 6337 - protein, 9 aa, Homo sapiens
NADLLRSAV

SEQ ID NO: 6338 - protein, 9 aa, Homo sapiens
HHAPVLLAW

SEQ ID NO: 6339 - protein, 9 aa, Homo sapiens
FTYERRPQS

SEQ ID NO: 6340 - protein, 9 aa, Homo sapiens
MPVPGQHSM

SEQ ID NO: 6341 - protein, 9 aa, Homo sapiens
AAVFRHPAF

SEQ ID NO: 6342 - protein, 9 aa, Homo sapiens
AVFRHPAFI

SEQ ID NO: 6343 - protein, 9 aa, Homo sapiens
YPHSFPSQY

SEQ ID NO: 6344 - protein, 9 aa, Homo sapiens
YPHSFPSQY

SEQ ID NO: 6345 - protein, 9 aa, Homo sapiens
VHGSYPHSF

SEQ ID NO: 6346 - protein, 9 aa, Homo sapiens
YPHSFPSQY

SEQ ID NO: 6347 - protein, 9 aa, Homo sapiens
GAQFALVTL

SEQ ID NO: 6348 - protein, 9 aa, Homo sapiens
PAGFPGPFI

SEQ ID NO: 6349 - protein, 9 aa, Homo sapiens
FQVCADKVL

SEQ ID NO: 6350 - protein, 9 aa, Homo sapiens
VNHSTAPYS

SEQ ID NO: 6351 - protein, 9 aa, Homo sapiens
KIFGPMASV

SEQ ID NO: 6352 - protein, 9 aa, Homo sapiens
MSLGPMGSV

SEQ ID NO: 6353 - protein, 9 aa, Homo sapiens
LCSRRVNMI

SEQ ID NO: 6354 - protein, 9 aa, Homo sapiens
VPLEARPVR

SEQ ID NO: 6355 - protein, 9 aa, Homo sapiens
DPVRRNASI

SEQ ID NO: 6356 - protein, 9 aa, Homo sapiens
FSGVFVGVI

SEQ ID NO: 6357 - protein, 9 aa, Homo sapiens
DEDDDVLSI

SEQ ID NO: 6358 - protein, 9 aa, Homo sapiens
DEDDDVLSI

SEQ ID NO: 6359 - protein, 9 aa, Homo sapiens
RLLDRTVDR

SEQ ID NO: 6360 - protein, 9 aa, Homo sapiens
LEEQKRLLD

SEQ ID NO: 6361 - protein, 9 aa, Homo sapiens
LLDRTVDRL

SEQ ID NO: 6362 - protein, 9 aa, Homo sapiens
QAEERSKQL

SEQ ID NO: 6363 - protein, 9 aa, Homo sapiens
HFFCDTPPV

SEQ ID NO: 6364 - protein, 9 aa, Homo sapiens
FFCDTPPVL

SEQ ID NO: 6365 - protein, 9 aa, Homo sapiens
FSSSGQWKV

SEQ ID NO: 6366 - protein, 9 aa, Homo sapiens
TVIIFPGEY

SEQ ID NO: 6367 - protein, 9 aa, Homo sapiens
RLCDHPVPV

SEQ ID NO: 6368 - protein, 9 aa, Homo sapiens
HVRQGKRRK

SEQ ID NO: 6369 - protein, 9 aa, Homo sapiens
VAEDRTRVV

SEQ ID NO: 6370 - protein, 9 aa, Homo sapiens
TAKSGGLSV

SEQ ID NO: 6371 - protein, 9 aa, Homo sapiens
AMFVLLHRQ

SEQ ID NO: 6372 - protein, 9 aa, Homo sapiens
RQYDGIGGL

SEQ ID NO: 6373 - protein, 9 aa, Homo sapiens
RQANLLKGK

SEQ ID NO: 6374 - protein, 9 aa, Homo sapiens
LLKGKQLLR

SEQ ID NO: 6375 - protein, 9 aa, Homo sapiens
RQANLLKGK

SEQ ID NO: 6376 - protein, 9 aa, Homo sapiens
AIFTYMRPK

SEQ ID NO: 6377 - protein, 9 aa, Homo sapiens
GAAIFTYMR

SEQ ID NO: 6378 - protein, 9 aa, Homo sapiens
AIFTYMRPK

SEQ ID NO: 6379 - protein, 9 aa, Homo sapiens
FTYMRPKSH

SEQ ID NO: 6380 - protein, 9 aa, Homo sapiens
YSYKVQSTI

SEQ ID NO: 6381 - protein, 9 aa, Homo sapiens
STVVCTLTR

SEQ ID NO: 6382 - protein, 9 aa, Homo sapiens
VTLAAEACR

SEQ ID NO: 6383 - protein, 9 aa, Homo sapiens
NEALGRELM

SEQ ID NO: 6384 - protein, 9 aa, Homo sapiens
EALGRELML

SEQ ID NO: 6385 - protein, 9 aa, Homo sapiens
YVMIFRAVM

SEQ ID NO: 6386 - protein, 9 aa, Homo sapiens
LIHRFGQCV

SEQ ID NO: 6387 - protein, 9 aa, Homo sapiens
FGQCVPPPV

SEQ ID NO: 6388 - protein, 9 aa, Homo sapiens
DSLLILFSY

SEQ ID NO: 6389 - protein, 9 aa, Homo sapiens
LILFSYALI

SEQ ID NO: 6390 - protein, 9 aa, Homo sapiens
ILFSYALIL

SEQ ID NO: 6391 - protein, 9 aa, Homo sapiens
FSYALILRT

SEQ ID NO: 6392 - protein, 9 aa, Homo sapiens
YIYQFFEDK

SEQ ID NO: 6393 - protein, 9 aa, Homo sapiens
YIYQFFEDK

SEQ ID NO: 6394 - protein, 9 aa, Homo sapiens
YIYQFFEDK

SEQ ID NO: 6395 - protein, 9 aa, Homo sapiens
TGPRMPLLK

SEQ ID NO: 6396 - protein, 9 aa, Homo sapiens
YVNNSLSFF

SEQ ID NO: 6397 - protein, 9 aa, Homo sapiens
EVIPKGHIF

SEQ ID NO: 6398 - protein, 9 aa, Homo sapiens
YTLKNAEMK

SEQ ID NO: 6399 - protein, 9 aa, Homo sapiens
AEMKSAMRK

SEQ ID NO: 6400 - protein, 9 aa, Homo sapiens
YTLKNAEMK

SEQ ID NO: 6401 - protein, 9 aa, Homo sapiens
AEMKSAMRK

SEQ ID NO: 6402 - protein, 9 aa, Homo sapiens
AIYLFTLMG

SEQ ID NO: 6403 - protein, 9 aa, Homo sapiens
YLFTLMGNL

SEQ ID NO: 6404 - protein, 9 aa, Homo sapiens
MGNLGLILV

SEQ ID NO: 6405 - protein, 9 aa, Homo sapiens
LARTASPEK

SEQ ID NO: 6406 - protein, 9 aa, Homo sapiens
ARTASPEKK

SEQ ID NO: 6407 - protein, 9 aa, Homo sapiens
LTVRRGEEI

SEQ ID NO: 6408 - protein, 9 aa, Homo sapiens
LPFSGFHAM

SEQ ID NO: 6409 - protein, 9 aa, Homo sapiens
LPFSGFHAM

SEQ ID NO: 6410 - protein, 9 aa, Homo sapiens
FHAMPEEFL

SEQ ID NO: 6411 - protein, 9 aa, Homo sapiens
VVGAGGVGK

SEQ ID NO: 6412 - protein, 9 aa, Homo sapiens
TEATLSFGY

SEQ ID NO: 6413 - protein, 9 aa, Homo sapiens
TSFQASGYN

SEQ ID NO: 6414 - protein, 9 aa, Homo sapiens
TSFQASGYN

SEQ ID NO: 6415 - protein, 9 aa, Homo sapiens
EVPPPSSPV

SEQ ID NO: 6416 - protein, 9 aa, Homo sapiens
SQRAEMLQK

SEQ ID NO: 6417 - protein, 9 aa, Homo sapiens
YPPSQIARL

SEQ ID NO: 6418 - protein, 9 aa, Homo sapiens
YPPSQIARL

SEQ ID NO: 6419 - protein, 9 aa, Homo sapiens
HLVNHLGHY

SEQ ID NO: 6420 - protein, 9 aa, Homo sapiens
GSKEGFYMY

SEQ ID NO: 6421 - protein, 9 aa, Homo sapiens
YYLICLQQI

SEQ ID NO: 6422 - protein, 9 aa, Homo sapiens
YLICLQQIL

SEQ ID NO: 6423 - protein, 9 aa, Homo sapiens
KVIPLRESY

SEQ ID NO: 6424 - protein, 9 aa, Homo sapiens
VDSELWPTV

SEQ ID NO: 6425 - protein, 9 aa, Homo sapiens
KAAVRLKLL

SEQ ID NO: 6426 - protein, 9 aa, Homo sapiens
DMRDSYLGY

SEQ ID NO: 6427 - protein, 9 aa, Homo sapiens
LGYSTELAL

SEQ ID NO: 6428 - protein, 9 aa, Homo sapiens
KGCSSVLGH

SEQ ID NO: 6429 - protein, 9 aa, Homo sapiens
KGCSSVLGH

SEQ ID NO: 6430 - protein, 9 aa, Homo sapiens
TAGEVELKG

SEQ ID NO: 6431 - protein, 9 aa, Homo sapiens
CPQANRGVV

SEQ ID NO: 6432 - protein, 9 aa, Homo sapiens
QANRGVVRW

SEQ ID NO: 6433 - protein, 9 aa, Homo sapiens
KKREGELTV

SEQ ID NO: 6434 - protein, 9 aa, Homo sapiens
HALRMLAFR

SEQ ID NO: 6435 - protein, 9 aa, Homo sapiens
HALRMLAFR

SEQ ID NO: 6436 - protein, 9 aa, Homo sapiens
SAQHALRML

SEQ ID NO: 6437 - protein, 9 aa, Homo sapiens
NLVEADYSY

SEQ ID NO: 6438 - protein, 9 aa, Homo sapiens
MDVWYNLDK

SEQ ID NO: 6439 - protein, 9 aa, Homo sapiens
IEEQGKRNF

SEQ ID NO: 6440 - protein, 9 aa, Homo sapiens
DIYQVTGSL

SEQ ID NO: 6441 - protein, 9 aa, Homo sapiens
VIDEEIKKR

SEQ ID NO: 6442 - protein, 9 aa, Homo sapiens
EEWEFEVTA

SEQ ID NO: 6443 - protein, 9 aa, Homo sapiens
WEFEVTAFY

SEQ ID NO: 6444 - protein, 9 aa, Homo sapiens
WEFEVTAFY

SEQ ID NO: 6445 - protein, 9 aa, Homo sapiens
ALGCRKAMK

SEQ ID NO: 6446 - protein, 9 aa, Homo sapiens
KALGCRKAM

SEQ ID NO: 6447 - protein, 9 aa, Homo sapiens
HQMIHSGEK

SEQ ID NO: 6448 - protein, 9 aa, Homo sapiens
IPFPSFLSG

SEQ ID NO: 6449 - protein, 9 aa, Homo sapiens
IPFPSFLSG

SEQ ID NO: 6450 - protein, 9 aa, Homo sapiens
LSVRPGPTV

SEQ ID NO: 6451 - protein, 9 aa, Homo sapiens
YQCPICRLR

SEQ ID NO: 6452 - protein, 9 aa, Homo sapiens
GIYPASTQL

SEQ ID NO: 6453 - protein, 9 aa, Homo sapiens
QSQVDSQHV

SEQ ID NO: 6454 - protein, 9 aa, Homo sapiens
DSQHVGHSV

SEQ ID NO: 6455 - protein, 9 aa, Homo sapiens
VEAKWVEVK

SEQ ID NO: 6456 - protein, 9 aa, Homo sapiens
KSKRRDMTV

SEQ ID NO: 6457 - protein, 9 aa, Homo sapiens
ISGTVSCQK

SEQ ID NO: 6458 - protein, 9 aa, Homo sapiens
ISGTVSCQK

SEQ ID NO: 6459 - protein, 9 aa, Homo sapiens
GFSFNAPLK

SEQ ID NO: 6460 - protein, 9 aa, Homo sapiens
FGFSFNAPL

SEQ ID NO: 6461 - protein, 9 aa, Homo sapiens
FVLHDPEAR

SEQ ID NO: 6462 - protein, 9 aa, Homo sapiens
CGDYSDELK

SEQ ID NO: 6463 - protein, 9 aa, Homo sapiens
CPAATPVPI

SEQ ID NO: 6464 - protein, 9 aa, Homo sapiens
IPCPAATPV

SEQ ID NO: 6465 - protein, 9 aa, Homo sapiens
CPAATPVPI

SEQ ID NO: 6466 - protein, 9 aa, Homo sapiens
PAATPVPIV

SEQ ID NO: 6467 - protein, 9 aa, Homo sapiens
DTSRSSVSL

SEQ ID NO: 6468 - protein, 9 aa, Homo sapiens
PATKEPDTT

SEQ ID NO: 6469 - protein, 9 aa, Homo sapiens
TLHITKTMK

SEQ ID NO: 6470 - protein, 9 aa, Homo sapiens
FVETLHITK

SEQ ID NO: 6471 - protein, 9 aa, Homo sapiens
ETLHITKTM

SEQ ID NO: 6472 - protein, 9 aa, Homo sapiens
QTLATFYVK

SEQ ID NO: 6473 - protein, 9 aa, Homo sapiens
TLATFYVKY

SEQ ID NO: 6474 - protein, 9 aa, Homo sapiens
YVKYVQIFR

SEQ ID NO: 6475 - protein, 9 aa, Homo sapiens
QTLATFYVK

SEQ ID NO: 6476 - protein, 9 aa, Homo sapiens
TLATFYVKY

SEQ ID NO: 6477 - protein, 9 aa, Homo sapiens
LATFYVKYV

SEQ ID NO: 6478 - protein, 9 aa, Homo sapiens
FYVKYVQIF

SEQ ID NO: 6479 - protein, 9 aa, Homo sapiens
LQYIGWPAY

SEQ ID NO: 6480 - protein, 9 aa, Homo sapiens
LQYIGWPAY

SEQ ID NO: 6481 - protein, 9 aa, Homo sapiens
NASCCLPSV

SEQ ID NO: 6482 - protein, 9 aa, Homo sapiens
KESFNAIPT

SEQ ID NO: 6483 - protein, 9 aa, Homo sapiens
YTYFVKKKK

SEQ ID NO: 6484 - protein, 9 aa, Homo sapiens
FVKKKKESF

SEQ ID NO: 6485 - protein, 9 aa, Homo sapiens
KKKESFNAI

SEQ ID NO: 6486 - protein, 9 aa, Homo sapiens
QSNCFPGVV

SEQ ID NO: 6487 - protein, 9 aa, Homo sapiens
FPGVVQTTY

SEQ ID NO: 6488 - protein, 9 aa, Homo sapiens
LLQGGTSRK

SEQ ID NO: 6489 - protein, 9 aa, Homo sapiens
LLQGGTSRK

SEQ ID NO: 6490 - protein, 9 aa, Homo sapiens
KVYIFRADR

SEQ ID NO: 6491 - protein, 9 aa, Homo sapiens
GIGKVYIFR

SEQ ID NO: 6492 - protein, 9 aa, Homo sapiens
KVYIFRADR

SEQ ID NO: 6493 - protein, 9 aa, Homo sapiens
LSLGIILFC

SEQ ID NO: 6494 - protein, 9 aa, Homo sapiens
LSLGIILFC

SEQ ID NO: 6495 - protein, 9 aa, Homo sapiens
IILFCYVEI

SEQ ID NO: 6496 - protein, 9 aa, Homo sapiens
ILFCYVEIL

SEQ ID NO: 6497 - protein, 9 aa, Homo sapiens
CYVEILRTL

SEQ ID NO: 6498 - protein, 9 aa, Homo sapiens
TSASDVWSY

SEQ ID NO: 6499 - protein, 9 aa, Homo sapiens
RKFTSASDV

SEQ ID NO: 6500 - protein, 9 aa, Homo sapiens
REHLAEVTL

SEQ ID NO: 6501 - protein, 9 aa, Homo sapiens
FKREHLAEV

SEQ ID NO: 6502 - protein, 9 aa, Homo sapiens
LPKRDTNLV

SEQ ID NO: 6503 - protein, 9 aa, Homo sapiens
YECENCAKV

SEQ ID NO: 6504 - protein, 9 aa, Homo sapiens
DSPGRPVPV

SEQ ID NO: 6505 - protein, 9 aa, Homo sapiens
TDNTETVPK

SEQ ID NO: 6506 - protein, 9 aa, Homo sapiens
SETDNTETV

SEQ ID NO: 6507 - protein, 9 aa, Homo sapiens
FFFSHIGWL

SEQ ID NO: 6508 - protein, 9 aa, Homo sapiens
FSHIGWLFV

SEQ ID NO: 6509 - protein, 9 aa, Homo sapiens
KITSFEEAK

SEQ ID NO: 6510 - protein, 9 aa, Homo sapiens
GSFVFAVTV

SEQ ID NO: 6511 - protein, 9 aa, Homo sapiens
ATRCNREKK

SEQ ID NO: 6512 - protein, 9 aa, Homo sapiens
DPVLEQNPF

SEQ ID NO: 6513 - protein, 9 aa, Homo sapiens
EQNPFDVFL

SEQ ID NO: 6514 - protein, 9 aa, Homo sapiens
NPFDVFLSP

SEQ ID NO: 6515 - protein, 9 aa, Homo sapiens
KMIYSISHY

SEQ ID NO: 6516 - protein, 9 aa, Homo sapiens
MIYSISHYY

SEQ ID NO: 6517 - protein, 9 aa, Homo sapiens
KMIYSISHY

SEQ ID NO: 6518 - protein, 9 aa, Homo sapiens
MIYSISHYY

SEQ ID NO: 6519 - protein, 9 aa, Homo sapiens
TLINAIKMI

SEQ ID NO: 6520 - protein, 9 aa, Homo sapiens
NAIKMIYSI

SEQ ID NO: 6521 - protein, 9 aa, Homo sapiens
MIYSISHYY

SEQ ID NO: 6522 - protein, 9 aa, Homo sapiens
AFQPCIPSK

SEQ ID NO: 6523 - protein, 9 aa, Homo sapiens
VAFQPCIPS

SEQ ID NO: 6524 - protein, 9 aa, Homo sapiens
RTKGCEMAR

SEQ ID NO: 6525 - protein, 9 aa, Homo sapiens
DYYSHERCT

SEQ ID NO: 6526 - protein, 9 aa, Homo sapiens
YYSHERCTL

SEQ ID NO: 6527 - protein, 9 aa, Homo sapiens
YSHERCTLI

SEQ ID NO: 6528 - protein, 9 aa, Homo sapiens
KTRGFSFPR

SEQ ID NO: 6529 - protein, 9 aa, Homo sapiens
KTRGFSFPR

SEQ ID NO: 6530 - protein, 9 aa, Homo sapiens
FAGPRCEKL

SEQ ID NO: 6531 - protein, 9 aa, Homo sapiens
HLYGLHEGQ

SEQ ID NO: 6532 - protein, 9 aa, Homo sapiens
YGLHEGQRV

SEQ ID NO: 6533 - protein, 9 aa, Homo sapiens
SALTNEIIV

SEQ ID NO: 6534 - protein, 9 aa, Homo sapiens
LTNEIIVTM

SEQ ID NO: 6535 - protein, 9 aa, Homo sapiens
TEIFYQFTS

SEQ ID NO: 6536 - protein, 9 aa, Homo sapiens
IFYQFTSFL

SEQ ID NO: 6537 - protein, 9 aa, Homo sapiens
GASHVFKFV

SEQ ID NO: 6538 - protein, 9 aa, Homo sapiens
REYKMDLYV

SEQ ID NO: 6539 - protein, 9 aa, Homo sapiens
HEFGRLLAT

SEQ ID NO: 6540 - protein, 9 aa, Homo sapiens
HEFGRLLAT

SEQ ID NO: 6541 - protein, 9 aa, Homo sapiens
ISLKKPSAA

SEQ ID NO: 6542 - protein, 9 aa, Homo sapiens
FVVDPPHII

SEQ ID NO: 6543 - protein, 9 aa, Homo sapiens
VVDPPHIII

SEQ ID NO: 6544 - protein, 9 aa, Homo sapiens
AAVTFGTAI

SEQ ID NO: 6545 - protein, 9 aa, Homo sapiens
FGTAIAAFY

SEQ ID NO: 6546 - protein, 9 aa, Homo sapiens
AENTVQEEV

SEQ ID NO: 6547 - protein, 9 aa, Homo sapiens
RAHFERYLL

SEQ ID NO: 6548 - protein, 9 aa, Homo sapiens
VTAKIDHGN

SEQ ID NO: 6549 - protein, 9 aa, Homo sapiens
RGLARRPAK

SEQ ID NO: 6550 - protein, 9 aa, Homo sapiens
VVDAIDVLK

SEQ ID NO: 6551 - protein, 9 aa, Homo sapiens
FSTIVVDAI

SEQ ID NO: 6552 - protein, 9 aa, Homo sapiens
IVVDAIDVL

SEQ ID NO: 6553 - protein, 9 aa, Homo sapiens
LLSSCRHVI

SEQ ID NO: 6554 - protein, 9 aa, Homo sapiens
LIKRRGPYE

SEQ ID NO: 6555 - protein, 9 aa, Homo sapiens
ETSPSLLDY

SEQ ID NO: 6556 - protein, 9 aa, Homo sapiens
LIKRRGPYE

SEQ ID NO: 6557 - protein, 9 aa, Homo sapiens
ETSPSLLDY

SEQ ID NO: 6558 - protein, 9 aa, Homo sapiens
GVVQMTFLR

SEQ ID NO: 6559 - protein, 9 aa, Homo sapiens
PSMLDSIWK

SEQ ID NO: 6560 - protein, 9 aa, Homo sapiens
VVGLIQDLK

SEQ ID NO: 6561 - protein, 9 aa, Homo sapiens
VVGLIQDLK

SEQ ID NO: 6562 - protein, 9 aa, Homo sapiens
IQDLKPNTI

SEQ ID NO: 6563 - protein, 9 aa, Homo sapiens
DLKPNTIMV

SEQ ID NO: 6564 - protein, 9 aa, Homo sapiens
PDSESSFTY

SEQ ID NO: 6565 - protein, 9 aa, Homo sapiens
HTVYGEPRK

SEQ ID NO: 6566 - protein, 9 aa, Homo sapiens
HTVYGEPRK

SEQ ID NO: 6567 - protein, 9 aa, Homo sapiens
TVYGEPRKL

SEQ ID NO: 6568 - protein, 9 aa, Homo sapiens
SLWPGTVPK

SEQ ID NO: 6569 - protein, 9 aa, Homo sapiens
KLFADKILK

SEQ ID NO: 6570 - protein, 9 aa, Homo sapiens
FADKILKTA

SEQ ID NO: 6571 - protein, 9 aa, Homo sapiens
FSDEGTCVA

SEQ ID NO: 6572 - protein, 9 aa, Homo sapiens
FSDEGTCVA

SEQ ID NO: 6573 - protein, 9 aa, Homo sapiens
TMRDTMKYV

SEQ ID NO: 6574 - protein, 9 aa, Homo sapiens
GLTIQAVRV

SEQ ID NO: 6575 - protein, 9 aa, Homo sapiens
TIQAVRVTK

SEQ ID NO: 6576 - protein, 9 aa, Homo sapiens
KMVAVFYTT

SEQ ID NO: 6577 - protein, 9 aa, Homo sapiens
MVAVFYTTV

SEQ ID NO: 6578 - protein, 9 aa, Homo sapiens
SLGEVGHHI

SEQ ID NO: 6579 - protein, 9 aa, Homo sapiens
GEVGHHIDL

SEQ ID NO: 6580 - protein, 9 aa, Homo sapiens
SLSDIKGAA

SEQ ID NO: 6581 - protein, 9 aa, Homo sapiens
KASRNESTF

SEQ ID NO: 6582 - protein, 9 aa, Homo sapiens
CGWPTTITV

SEQ ID NO: 6583 - protein, 9 aa, Homo sapiens
LLDDRETCN

SEQ ID NO: 6584 - protein, 9 aa, Homo sapiens
YVTAMDLFV

SEQ ID NO: 6585 - protein, 9 aa, Homo sapiens
TAMDLFVTV

SEQ ID NO: 6586 - protein, 9 aa, Homo sapiens
LELANRFPQ

SEQ ID NO: 6587 - protein, 9 aa, Homo sapiens
LELANRFPQ

SEQ ID NO: 6588 - protein, 9 aa, Homo sapiens
EEGPAPEPH

SEQ ID NO: 6589 - protein, 9 aa, Homo sapiens
LLGLVLGGI

SEQ ID NO: 6590 - protein, 9 aa, Homo sapiens
LVLGGIVLA

SEQ ID NO: 6591 - protein, 9 aa, Homo sapiens
VLGGIVLAV

SEQ ID NO: 6592 - protein, 9 aa, Homo sapiens
LQGAQLIAV

SEQ ID NO: 6593 - protein, 9 aa, Homo sapiens
VMLQLLAMK

SEQ ID NO: 6594 - protein, 9 aa, Homo sapiens
MLQLLAMKV

SEQ ID NO: 6595 - protein, 9 aa, Homo sapiens
LLAMKVPNV

SEQ ID NO: 6596 - protein, 9 aa, Homo sapiens
MKVPNVLTF

SEQ ID NO: 6597 - protein, 9 aa, Homo sapiens
SVMLQLLAM

SEQ ID NO: 6598 - protein, 9 aa, Homo sapiens
MLQLLAMKV

SEQ ID NO: 6599 - protein, 9 aa, Homo sapiens
LLAMKVPNV

SEQ ID NO: 6600 - protein, 9 aa, Homo sapiens
VMLQLLAMK

SEQ ID NO: 6601 - protein, 9 aa, Homo sapiens
YLQDSLATT

SEQ ID NO: 6602 - protein, 9 aa, Homo sapiens
FLMTLETKM

SEQ ID NO: 6603 - protein, 9 aa, Homo sapiens
MTLETKMNL

SEQ ID NO: 6604 - protein, 9 aa, Homo sapiens
KMNLTKLGK

SEQ ID NO: 6605 - protein, 9 aa, Homo sapiens
LETKMNLTK

SEQ ID NO: 6606 - protein, 9 aa, Homo sapiens
EESETQGPM

SEQ ID NO: 6607 - protein, 9 aa, Homo sapiens
RDELAYWGI

SEQ ID NO: 6608 - protein, 9 aa, Homo sapiens
MDFGLALLL

SEQ ID NO: 6609 - protein, 9 aa, Homo sapiens
DETVRLWDV

SEQ ID NO: 6610 - protein, 9 aa, Homo sapiens
SMDRDYHVA

SEQ ID NO: 6611 - protein, 9 aa, Homo sapiens
CETTIRVVS

SEQ ID NO: 6612 - protein, 9 aa, Homo sapiens
CETTIRVVS

SEQ ID NO: 6613 - protein, 9 aa, Homo sapiens
IVRGSKGAK

SEQ ID NO: 6614 - protein, 9 aa, Homo sapiens
VELPTEEPE

SEQ ID NO: 6615 - protein, 9 aa, Homo sapiens
SLLKDILHL

SEQ ID NO: 6616 - protein, 9 aa, Homo sapiens
VADSANYSC

SEQ ID NO: 6617 - protein, 9 aa, Homo sapiens
GTANRPPAK

SEQ ID NO: 6618 - protein, 9 aa, Homo sapiens
KTTTWLFET

SEQ ID NO: 6619 - protein, 9 aa, Homo sapiens
FETTPLHEF

SEQ ID NO: 6620 - protein, 9 aa, Homo sapiens
FETTPLHEF

SEQ ID NO: 6621 - protein, 9 aa, Homo sapiens
YEIWRSDSF

SEQ ID NO: 6622 - protein, 9 aa, Homo sapiens
YEIWRSDSF

SEQ ID NO: 6623 - protein, 9 aa, Homo sapiens
KETSINGLL

SEQ ID NO: 6624 - protein, 9 aa, Homo sapiens
VEFVDVSSV

SEQ ID NO: 6625 - protein, 9 aa, Homo sapiens
VEFVDVSSV

SEQ ID NO: 6626 - protein, 9 aa, Homo sapiens
YASRNSSQL

SEQ ID NO: 6627 - protein, 9 aa, Homo sapiens
VSSILVTRF

SEQ ID NO: 6628 - protein, 9 aa, Homo sapiens
ALSFHYLFA

SEQ ID NO: 6629 - protein, 9 aa, Homo sapiens
YLFAIFSGL

SEQ ID NO: 6630 - protein, 9 aa, Homo sapiens
DETSLGRAQ

SEQ ID NO: 6631 - protein, 9 aa, Homo sapiens
CIAENKHGL

SEQ ID NO: 6632 - protein, 9 aa, Homo sapiens
VTDSGMFQC

SEQ ID NO: 6633 - protein, 9 aa, Homo sapiens
AIGLTSFVI

SEQ ID NO: 6634 - protein, 9 aa, Homo sapiens
GLTSFVIAI

SEQ ID NO: 6635 - protein, 9 aa, Homo sapiens
VIAILVIQV

SEQ ID NO: 6636 - protein, 9 aa, Homo sapiens
GLLLILGIA

SEQ ID NO: 6637 - protein, 9 aa, Homo sapiens
LLLILGIAL

SEQ ID NO: 6638 - protein, 9 aa, Homo sapiens
LLILGIALI

SEQ ID NO: 6639 - protein, 9 aa, Homo sapiens
LILGIALIV

SEQ ID NO: 6640 - protein, 9 aa, Homo sapiens
ILYKKMGKL

SEQ ID NO: 6641 - protein, 9 aa, Homo sapiens
ALRRLTAFL

SEQ ID NO: 6642 - protein, 9 aa, Homo sapiens
SLIKKRFAT

SEQ ID NO: 6643 - protein, 9 aa, Homo sapiens
SLAYHLAKA

SEQ ID NO: 6644 - protein, 9 aa, Homo sapiens
VSLAYHLAK

SEQ ID NO: 6645 - protein, 9 aa, Homo sapiens
AVYRLVLTA

SEQ ID NO: 6646 - protein, 9 aa, Homo sapiens
REGEAVYRL

SEQ ID NO: 6647 - protein, 9 aa, Homo sapiens
GEAVYRLVL

SEQ ID NO: 6648 - protein, 9 aa, Homo sapiens
TLDREGEAV

SEQ ID NO: 6649 - protein, 9 aa, Homo sapiens
SVVYEWALK

SEQ ID NO: 6650 - protein, 9 aa, Homo sapiens
VVYEWALKK

SEQ ID NO: 6651 - protein, 9 aa, Homo sapiens
EEDSVVYEW

SEQ ID NO: 6652 - protein, 9 aa, Homo sapiens
VLEEDSVVY

SEQ ID NO: 6653 - protein, 9 aa, Homo sapiens
HLNTLEGKK

SEQ ID NO: 6654 - protein, 9 aa, Homo sapiens
SLLEYYTEL

SEQ ID NO: 6655 - protein, 9 aa, Homo sapiens
IIMPYKAAH

SEQ ID NO: 6656 - protein, 9 aa, Homo sapiens
WQDHHSLRV

SEQ ID NO: 6657 - protein, 9 aa, Homo sapiens
KEIPDLPEE

SEQ ID NO: 6658 - protein, 9 aa, Homo sapiens
KDARIVYII

SEQ ID NO: 6659 - protein, 9 aa, Homo sapiens
SVAGGTQPL

SEQ ID NO: 6660 - protein, 9 aa, Homo sapiens
GTQPLLLAK

SEQ ID NO: 6661 - protein, 9 aa, Homo sapiens
IMKDVPSYK

SEQ ID NO: 6662 - protein, 9 aa, Homo sapiens
VVQSSKPPV

SEQ ID NO: 6663 - protein, 9 aa, Homo sapiens
LLVFLSCGL

SEQ ID NO: 6664 - protein, 9 aa, Homo sapiens
RRRKTSKSK

SEQ ID NO: 6665 - protein, 9 aa, Homo sapiens
FEAVSIWDI

SEQ ID NO: 6666 - protein, 9 aa, Homo sapiens
LADMTGLSR

SEQ ID NO: 6667 - protein, 9 aa, Homo sapiens
LLEAVEPEV

SEQ ID NO: 6668 - protein, 9 aa, Homo sapiens
RLLKGEASL

SEQ ID NO: 6669 - protein, 9 aa, Homo sapiens
TLGLRQRLL

SEQ ID NO: 6670 - protein, 9 aa, Homo sapiens
TLFGVLNYT

SEQ ID NO: 6671 - protein, 9 aa, Homo sapiens
YRNNHTLFG

SEQ ID NO: 6672 - protein, 9 aa, Homo sapiens
KTLAFAGQV

SEQ ID NO: 6673 - protein, 9 aa, Homo sapiens
TWKEYPKPL

SEQ ID NO: 6674 - protein, 9 aa, Homo sapiens
WQSATWKEY

SEQ ID NO: 6675 - protein, 9 aa, Homo sapiens
KEYPKPLQV

SEQ ID NO: 6676 - protein, 9 aa, Homo sapiens
ALKKKGTAE

SEQ ID NO: 6677 - protein, 9 aa, Homo sapiens
YRSGDATRT

SEQ ID NO: 6678 - protein, 9 aa, Homo sapiens
SLYGENDLL

SEQ ID NO: 6679 - protein, 9 aa, Homo sapiens
QQVTFLLKI

SEQ ID NO: 6680 - protein, 9 aa, Homo sapiens
SRLKDPNII

SEQ ID NO: 6681 - protein, 9 aa, Homo sapiens
YHEANGNSV

SEQ ID NO: 6682 - protein, 9 aa, Homo sapiens
FFMLYLVTL

SEQ ID NO: 6683 - protein, 9 aa, Homo sapiens
FMLYLVTLM

SEQ ID NO: 6684 - protein, 9 aa, Homo sapiens
YLVTLMGNI

SEQ ID NO: 6685 - protein, 9 aa, Homo sapiens
FFMLYLVTL

SEQ ID NO: 6686 - protein, 9 aa, Homo sapiens
FFMLYLVTL

SEQ ID NO: 6687 - protein, 9 aa, Homo sapiens
KLRQTKDAL

SEQ ID NO: 6688 - protein, 9 aa, Homo sapiens
VLEGNVGYL

SEQ ID NO: 6689 - protein, 9 aa, Homo sapiens
HLAEVSAEG

SEQ ID NO: 6690 - protein, 9 aa, Homo sapiens
VSAEGKLLF

SEQ ID NO: 6691 - protein, 9 aa, Homo sapiens
REMNLSETA

SEQ ID NO: 6692 - protein, 9 aa, Homo sapiens
MHQKIAREM

SEQ ID NO: 6693 - protein, 9 aa, Homo sapiens
IFPGIGCPV

SEQ ID NO: 6694 - protein, 9 aa, Homo sapiens
TFSNRPVLI

SEQ ID NO: 6695 - protein, 9 aa, Homo sapiens
TFSNRPVLI

SEQ ID NO: 6696 - protein, 9 aa, Homo sapiens
THMFYASAF

SEQ ID NO: 6697 - protein, 9 aa, Homo sapiens
THMFYASAF

SEQ ID NO: 6698 - protein, 9 aa, Homo sapiens
RRLTKNATA

SEQ ID NO: 6699 - protein, 9 aa, Homo sapiens
IMWARMDVA

SEQ ID NO: 6700 - protein, 9 aa, Homo sapiens
NEVQAGYPR

SEQ ID NO: 6701 - protein, 9 aa, Homo sapiens
QEIMCHSEF

SEQ ID NO: 6702 - protein, 9 aa, Homo sapiens
EHKYGGHLV

SEQ ID NO: 6703 - protein, 9 aa, Homo sapiens
SFCKAGGTL

SEQ ID NO: 6704 - protein, 9 aa, Homo sapiens
TRSRIVHEI

SEQ ID NO: 6705 - protein, 9 aa, Homo sapiens
EEPFVLPPA

SEQ ID NO: 6706 - protein, 9 aa, Homo sapiens
CHQVSYGEM

SEQ ID NO: 6707 - protein, 9 aa, Homo sapiens
ILVAQIFGL

SEQ ID NO: 6708 - protein, 9 aa, Homo sapiens
AQIFGLEFI

SEQ ID NO: 6709 - protein, 9 aa, Homo sapiens
QIFGLEFIL

SEQ ID NO: 6710 - protein, 9 aa, Homo sapiens
LEFILGSEE

SEQ ID NO: 6711 - protein, 9 aa, Homo sapiens
NVMGDYRFF

SEQ ID NO: 6712 - protein, 9 aa, Homo sapiens
SHHNVMGDY

SEQ ID NO: 6713 - protein, 9 aa, Homo sapiens
FSEDQRKAL

SEQ ID NO: 6714 - protein, 9 aa, Homo sapiens
DEVDEFLSR

SEQ ID NO: 6715 - protein, 9 aa, Homo sapiens
AMVSNQGHM

SEQ ID NO: 6716 - protein, 9 aa, Homo sapiens
ALMLGMFVL

SEQ ID NO: 6717 - protein, 9 aa, Homo sapiens
VAFGSGALM

SEQ ID NO: 6718 - protein, 9 aa, Homo sapiens
VLSSDSFDL

SEQ ID NO: 6719 - protein, 9 aa, Homo sapiens
ALYWEPEAL

SEQ ID NO: 6720 - protein, 9 aa, Homo sapiens
WEPEALYTL

SEQ ID NO: 6721 - protein, 9 aa, Homo sapiens
RQLPDGTCV

SEQ ID NO: 6722 - protein, 9 aa, Homo sapiens
QLPDGTCVV

SEQ ID NO: 6723 - protein, 9 aa, Homo sapiens
FTSQFEVTV

SEQ ID NO: 6724 - protein, 9 aa, Homo sapiens
SQFEVTVWA

SEQ ID NO: 6725 - protein, 9 aa, Homo sapiens
THQHFTSQF

SEQ ID NO: 6726 - protein, 9 aa, Homo sapiens
QHFTSQFEV

SEQ ID NO: 6727 - protein, 9 aa, Homo sapiens
FHPVGFHVV

SEQ ID NO: 6728 - protein, 9 aa, Homo sapiens
FHVVNILLH

SEQ ID NO: 6729 - protein, 9 aa, Homo sapiens
RLDKYPTLL

SEQ ID NO: 6730 - protein, 9 aa, Homo sapiens
MRLDKYPTL

SEQ ID NO: 6731 - protein, 9 aa, Homo sapiens
MRLDKYPTL

SEQ ID NO: 6732 - protein, 9 aa, Homo sapiens
MSKLKSRYL

SEQ ID NO: 6733 - protein, 9 aa, Homo sapiens
RYPCEWGGV

SEQ ID NO: 6734 - protein, 9 aa, Homo sapiens
MYKLTGAIM

SEQ ID NO: 6735 - protein, 9 aa, Homo sapiens
LHSPGLPLV

SEQ ID NO: 6736 - protein, 9 aa, Homo sapiens
GLISIAART

SEQ ID NO: 6737 - protein, 9 aa, Homo sapiens
ARTVITHLV

SEQ ID NO: 6738 - protein, 9 aa, Homo sapiens
YLRLRGRCP

SEQ ID NO: 6739 - protein, 9 aa, Homo sapiens
RLRGRCPLL

SEQ ID NO: 6740 - protein, 9 aa, Homo sapiens
LRGRCPLLL

SEQ ID NO: 6741 - protein, 9 aa, Homo sapiens
IRPYFNRVI

SEQ ID NO: 6742 - protein, 9 aa, Homo sapiens
YLQALASKM

SEQ ID NO: 6743 - protein, 9 aa, Homo sapiens
KMTEELEAL

SEQ ID NO: 6744 - protein, 9 aa, Homo sapiens
IRSDPGLTA

SEQ ID NO: 6745 - protein, 9 aa, Homo sapiens
QAKKGLLTL

SEQ ID NO: 6746 - protein, 9 aa, Homo sapiens
NLFETPVEA

SEQ ID NO: 6747 - protein, 9 aa, Homo sapiens
FETPVEAQY

SEQ ID NO: 6748 - protein, 9 aa, Homo sapiens
DDPRWIGAW

SEQ ID NO: 6749 - protein, 9 aa, Homo sapiens
ILNVDVFTL

SEQ ID NO: 6750 - protein, 9 aa, Homo sapiens
FHSILNVDV

SEQ ID NO: 6751 - protein, 9 aa, Homo sapiens
VMSMVGYII

SEQ ID NO: 6752 - protein, 9 aa, Homo sapiens
SYARSTAVM

SEQ ID NO: 6753 - protein, 9 aa, Homo sapiens
AVMSMVGYI

SEQ ID NO: 6754 - protein, 9 aa, Homo sapiens
QSYARSTAV

SEQ ID NO: 6755 - protein, 9 aa, Homo sapiens
HLEEFLPIF

SEQ ID NO: 6756 - protein, 9 aa, Homo sapiens
TEEKTQWEH

SEQ ID NO: 6757 - protein, 9 aa, Homo sapiens
NQSSTLEFI

SEQ ID NO: 6758 - protein, 9 aa, Homo sapiens
MRENNQSST

SEQ ID NO: 6759 - protein, 9 aa, Homo sapiens
LTVAYEHGV

SEQ ID NO: 6760 - protein, 9 aa, Homo sapiens
AEDVLTVAY

SEQ ID NO: 6761 - protein, 9 aa, Homo sapiens
DEASPLFGI

SEQ ID NO: 6762 - protein, 9 aa, Homo sapiens
GPEERKTHM

SEQ ID NO: 6763 - protein, 9 aa, Homo sapiens
SESSRGPSL

SEQ ID NO: 6764 - protein, 9 aa, Homo sapiens
KLRRREQEA

SEQ ID NO: 6765 - protein, 9 aa, Homo sapiens
VVIMASTPL

SEQ ID NO: 6766 - protein, 9 aa, Homo sapiens
VIMASTPLF

SEQ ID NO: 6767 - protein, 9 aa, Homo sapiens
FPDYHDPTI

SEQ ID NO: 6768 - protein, 9 aa, Homo sapiens
FLSPGTRAA

SEQ ID NO: 6769 - protein, 9 aa, Homo sapiens
IRSGAGVCV

SEQ ID NO: 6770 - protein, 9 aa, Homo sapiens
SLHREYSGR

SEQ ID NO: 6771 - protein, 9 aa, Homo sapiens
FMSNSPLRE

SEQ ID NO: 6772 - protein, 9 aa, Homo sapiens
LAVSGLRPV

SEQ ID NO: 6773 - protein, 9 aa, Homo sapiens
GLRPVQAQA

SEQ ID NO: 6774 - protein, 9 aa, Homo sapiens
WMDVIVTAA

SEQ ID NO: 6775 - protein, 9 aa, Homo sapiens
SLRNRKMGG

SEQ ID NO: 6776 - protein, 9 aa, Homo sapiens
VLIGTSVVI

SEQ ID NO: 6777 - protein, 9 aa, Homo sapiens
LLDAMSGRL

SEQ ID NO: 6778 - protein, 9 aa, Homo sapiens
LSGLYYNGL

SEQ ID NO: 6779 - protein, 9 aa, Homo sapiens
GRVKLTVNL

SEQ ID NO: 6780 - protein, 9 aa, Homo sapiens
GMSGRWVLA

SEQ ID NO: 6781 - protein, 9 aa, Homo sapiens
WILFLPMEW

SEQ ID NO: 6782 - protein, 9 aa, Homo sapiens
MEWGDSGVY

SEQ ID NO: 6783 - protein, 9 aa, Homo sapiens
VQIPYEVTL

SEQ ID NO: 6784 - protein, 9 aa, Homo sapiens
TLWILLASL

SEQ ID NO: 6785 - protein, 9 aa, Homo sapiens
YEVTLWILL

SEQ ID NO: 6786 - protein, 9 aa, Homo sapiens
TRGKKKGQM

SEQ ID NO: 6787 - protein, 9 aa, Homo sapiens
AHREVAQFC

SEQ ID NO: 6788 - protein, 9 aa, Homo sapiens
PESKRDILF

SEQ ID NO: 6789 - protein, 9 aa, Homo sapiens
SRSEAVRRL

SEQ ID NO: 6790 - protein, 9 aa, Homo sapiens
DEEELSGTK

SEQ ID NO: 6791 - protein, 9 aa, Homo sapiens
ALGASSCEI

SEQ ID NO: 6792 - protein, 9 aa, Homo sapiens
EPRPQEPPV

SEQ ID NO: 6793 - protein, 9 aa, Homo sapiens
SLSETRHPL

SEQ ID NO: 6794 - protein, 9 aa, Homo sapiens
VLFAAFSSA

SEQ ID NO: 6795 - protein, 9 aa, Homo sapiens
SREVAHGEV

SEQ ID NO: 6796 - protein, 9 aa, Homo sapiens
YHGDGMVCL

SEQ ID NO: 6797 - protein, 9 aa, Homo sapiens
SALQGGTSV

SEQ ID NO: 6798 - protein, 9 aa, Homo sapiens
YQGLWRSCV

SEQ ID NO: 6799 - protein, 9 aa, Homo sapiens
MLLKQDVSL

SEQ ID NO: 6800 - protein, 9 aa, Homo sapiens
MLLKQDVSL

SEQ ID NO: 6801 - protein, 9 aa, Homo sapiens
LHEEPPQAS

SEQ ID NO: 6802 - protein, 9 aa, Homo sapiens
FMRKRESQS

SEQ ID NO: 6803 - protein, 9 aa, Homo sapiens
MRKRESQSV

SEQ ID NO: 6804 - protein, 9 aa, Homo sapiens
MFARKHESP

SEQ ID NO: 6805 - protein, 9 aa, Homo sapiens
FARKHESPL

SEQ ID NO: 6806 - protein, 9 aa, Homo sapiens
HESPLLVTK

SEQ ID NO: 6807 - protein, 9 aa, Homo sapiens
FARKHESPL

SEQ ID NO: 6808 - protein, 9 aa, Homo sapiens
ARKHESPLL

SEQ ID NO: 6809 - protein, 9 aa, Homo sapiens
GLHDGIQRV

SEQ ID NO: 6810 - protein, 9 aa, Homo sapiens
LHDGIQRVL

SEQ ID NO: 6811 - protein, 9 aa, Homo sapiens
ILLKHKYSF

SEQ ID NO: 6812 - protein, 9 aa, Homo sapiens
ILLKHKYSF

SEQ ID NO: 6813 - protein, 9 aa, Homo sapiens
LLKHKYSFL

SEQ ID NO: 6814 - protein, 9 aa, Homo sapiens
ALIAILLCI

SEQ ID NO: 6815 - protein, 9 aa, Homo sapiens
LIAILLCII

SEQ ID NO: 6816 - protein, 9 aa, Homo sapiens
PELDEHYWV

SEQ ID NO: 6817 - protein, 9 aa, Homo sapiens
ARLDGIPEL

SEQ ID NO: 6818 - protein, 9 aa, Homo sapiens
SQSLVYFSV

SEQ ID NO: 6819 - protein, 9 aa, Homo sapiens
DESQSLVYF

SEQ ID NO: 6820 - protein, 9 aa, Homo sapiens
YRCECNEGF

SEQ ID NO: 6821 - protein, 9 aa, Homo sapiens
APLSTVIAL

SEQ ID NO: 6822 - protein, 9 aa, Homo sapiens
PLSTVIALI

SEQ ID NO: 6823 - protein, 9 aa, Homo sapiens
ARPNLLKNM

SEQ ID NO: 6824 - protein, 9 aa, Homo sapiens
RSNRQRQEV

SEQ ID NO: 6825 - protein, 9 aa, Homo sapiens
VLATFDPAR

SEQ ID NO: 6826 - protein, 9 aa, Homo sapiens
EGLQRSHIL

SEQ ID NO: 6827 - protein, 9 aa, Homo sapiens
TENICLDFY

SEQ ID NO: 6828 - protein, 9 aa, Homo sapiens
KLHTPANYL

SEQ ID NO: 6829 - protein, 9 aa, Homo sapiens
LHTPANYLI

SEQ ID NO: 6830 - protein, 9 aa, Homo sapiens
EIQRALWLL

SEQ ID NO: 6831 - protein, 9 aa, Homo sapiens
IYAFRNQEI

SEQ ID NO: 6832 - protein, 9 aa, Homo sapiens
EIQRALWLL

SEQ ID NO: 6833 - protein, 9 aa, Homo sapiens
FRNQEIQRA

SEQ ID NO: 6834 - protein, 9 aa, Homo sapiens
TLTRRIEDL

SEQ ID NO: 6835 - protein, 9 aa, Homo sapiens
TNVCRDASL

SEQ ID NO: 6836 - protein, 9 aa, Homo sapiens
CRDASLMAM

SEQ ID NO: 6837 - protein, 9 aa, Homo sapiens
SMGDCIGWL

SEQ ID NO: 6838 - protein, 9 aa, Homo sapiens
HYFSMGDCI

SEQ ID NO: 6839 - protein, 9 aa, Homo sapiens
FAASNIVAG

SEQ ID NO: 6840 - protein, 9 aa, Homo sapiens
IVAGVACLV

SEQ ID NO: 6841 - protein, 9 aa, Homo sapiens
SRPKKREGV

SEQ ID NO: 6842 - protein, 9 aa, Homo sapiens
VHLPTTKEL

SEQ ID NO: 6843 - protein, 9 aa, Homo sapiens
STLGTTILV

SEQ ID NO: 6844 - protein, 9 aa, Homo sapiens
MEISTLGTT

SEQ ID NO: 6845 - protein, 9 aa, Homo sapiens
ILVHCAVGV

SEQ ID NO: 6846 - protein, 9 aa, Homo sapiens
AVRCGSASI

SEQ ID NO: 6847 - protein, 9 aa, Homo sapiens
LLAILPYYV

SEQ ID NO: 6848 - protein, 9 aa, Homo sapiens
AILPYYVTI

SEQ ID NO: 6849 - protein, 9 aa, Homo sapiens
LPYYVTIFL

SEQ ID NO: 6850 - protein, 9 aa, Homo sapiens
IDLLAILPY

SEQ ID NO: 6851 - protein, 9 aa, Homo sapiens
RRYGHDFSI

SEQ ID NO: 6852 - protein, 9 aa, Homo sapiens
SIKKKWQTC

SEQ ID NO: 6853 - protein, 9 aa, Homo sapiens
SIKKKWQTC

SEQ ID NO: 6854 - protein, 9 aa, Homo sapiens
SEAAFDHSF

SEQ ID NO: 6855 - protein, 9 aa, Homo sapiens
SEAAFDHSF

SEQ ID NO: 6856 - protein, 9 aa, Homo sapiens
TLRREFSDT

SEQ ID NO: 6857 - protein, 9 aa, Homo sapiens
VEVVPNITY

SEQ ID NO: 6858 - protein, 9 aa, Homo sapiens
SWKHKLSQA

SEQ ID NO: 6859 - protein, 9 aa, Homo sapiens
AVDKLLAGD

SEQ ID NO: 6860 - protein, 9 aa, Homo sapiens
KLLAGDEIV

SEQ ID NO: 6861 - protein, 9 aa, Homo sapiens
NFKRREKCF

SEQ ID NO: 6862 - protein, 9 aa, Homo sapiens
LTLRLGPYL

SEQ ID NO: 6863 - protein, 9 aa, Homo sapiens
RLGPYLEFL

SEQ ID NO: 6864 - protein, 9 aa, Homo sapiens
LGPYLEFLV

SEQ ID NO: 6865 - protein, 9 aa, Homo sapiens
HHTDVANIF

SEQ ID NO: 6866 - protein, 9 aa, Homo sapiens
TPPTKPPSF

SEQ ID NO: 6867 - protein, 9 aa, Homo sapiens
FVWGPRARL

SEQ ID NO: 6868 - protein, 9 aa, Homo sapiens
RRSRRAVSV

SEQ ID NO: 6869 - protein, 9 aa, Homo sapiens
RRSRRAVSV

SEQ ID NO: 6870 - protein, 9 aa, Homo sapiens
FLLYKIVRG

SEQ ID NO: 6871 - protein, 9 aa, Homo sapiens
VRIKYKLSI

SEQ ID NO: 6872 - protein, 9 aa, Homo sapiens
GHGGDPGLV

SEQ ID NO: 6873 - protein, 9 aa, Homo sapiens
YLQEKLGAS

SEQ ID NO: 6874 - protein, 9 aa, Homo sapiens
KLGASPLHV

SEQ ID NO: 6875 - protein, 9 aa, Homo sapiens
RSRYRLQLR

SEQ ID NO: 6876 - protein, 9 aa, Homo sapiens
PRSRYRLQL

SEQ ID NO: 6877 - protein, 9 aa, Homo sapiens
YRLQLRARL

SEQ ID NO: 6878 - protein, 9 aa, Homo sapiens
LLDEKEPEV

SEQ ID NO: 6879 - protein, 9 aa, Homo sapiens
LLDEKEPEV

SEQ ID NO: 6880 - protein, 9 aa, Homo sapiens
VVLQCTATI

SEQ ID NO: 6881 - protein, 9 aa, Homo sapiens
LLLTFNVSV

SEQ ID NO: 6882 - protein, 9 aa, Homo sapiens
LTFNVSVNL

SEQ ID NO: 6883 - protein, 9 aa, Homo sapiens
GRQDFLFKA

SEQ ID NO: 6884 - protein, 9 aa, Homo sapiens
GLSQKATEV

SEQ ID NO: 6885 - protein, 9 aa, Homo sapiens
VTVTRSATR

SEQ ID NO: 6886 - protein, 9 aa, Homo sapiens
TRSATRRRR

SEQ ID NO: 6887 - protein, 9 aa, Homo sapiens
SRQKAEALL

SEQ ID NO: 6888 - protein, 9 aa, Homo sapiens
ERTQAAVYL

SEQ ID NO: 6889 - protein, 9 aa, Homo sapiens
RRLGRLWNR

SEQ ID NO: 6890 - protein, 9 aa, Homo sapiens
RSVAGLLPR

SEQ ID NO: 6891 - protein, 9 aa, Homo sapiens
GLAWCCYRL

SEQ ID NO: 6892 - protein, 9 aa, Homo sapiens
GILAEAPRV

SEQ ID NO: 6893 - protein, 9 aa, Homo sapiens
RLLVAALCA

SEQ ID NO: 6894 - protein, 9 aa, Homo sapiens
LVAALCAGI

SEQ ID NO: 6895 - protein, 9 aa, Homo sapiens
HHHHHHHHL

SEQ ID NO: 6896 - protein, 9 aa, Homo sapiens
MVLFCLLFL

SEQ ID NO: 6897 - protein, 9 aa, Homo sapiens
LSDGTTAYV

SEQ ID NO: 6898 - protein, 9 aa, Homo sapiens
LSDGTTAYV

SEQ ID NO: 6899 - protein, 9 aa, Homo sapiens
ATASAAVPV

SEQ ID NO: 6900 - protein, 9 aa, Homo sapiens
LLARFAASA

SEQ ID NO: 6901 - protein, 9 aa, Homo sapiens
DLYSNALKR

SEQ ID NO: 6902 - protein, 9 aa, Homo sapiens
SHSPHHQEA

SEQ ID NO: 6903 - protein, 9 aa, Homo sapiens
VSHKPLNDR

SEQ ID NO: 6904 - protein, 9 aa, Homo sapiens
KLTRLRIHV

SEQ ID NO: 6905 - protein, 9 aa, Homo sapiens
QPVAKTTAA

SEQ ID NO: 6906 - protein, 9 aa, Homo sapiens
LAVARGAPA

SEQ ID NO: 6907 - protein, 9 aa, Homo sapiens
MAAATASPR

SEQ ID NO: 6908 - protein, 9 aa, Homo sapiens
HPWDPGSPG

SEQ ID NO: 6909 - protein, 9 aa, Homo sapiens
HPWDPGSPG

SEQ ID NO: 6910 - protein, 9 aa, Homo sapiens
RRRGRLWDS

SEQ ID NO: 6911 - protein, 9 aa, Homo sapiens
AVVKMLPSF

SEQ ID NO: 6912 - protein, 9 aa, Homo sapiens
RRFTSCDLL

SEQ ID NO: 6913 - protein, 9 aa, Homo sapiens
SIYDNWIRY

SEQ ID NO: 6914 - protein, 9 aa, Homo sapiens
SIYDNWIRY

SEQ ID NO: 6915 - protein, 9 aa, Homo sapiens
FPNSPKWTS

SEQ ID NO: 6916 - protein, 9 aa, Homo sapiens
LAATLLPSL

SEQ ID NO: 6917 - protein, 9 aa, Homo sapiens
LPSLLLSLL

SEQ ID NO: 6918 - protein, 9 aa, Homo sapiens
LADPSLPPN

SEQ ID NO: 6919 - protein, 9 aa, Homo sapiens
LADPSLPPN

SEQ ID NO: 6920 - protein, 9 aa, Homo sapiens
LPPNVCTSL

SEQ ID NO: 6921 - protein, 9 aa, Homo sapiens
FAREALRAL

SEQ ID NO: 6922 - protein, 9 aa, Homo sapiens
FAREALRAL

SEQ ID NO: 6923 - protein, 9 aa, Homo sapiens
LALLLASTL

SEQ ID NO: 6924 - protein, 9 aa, Homo sapiens
ERRPSSTSV

SEQ ID NO: 6925 - protein, 9 aa, Homo sapiens
LPRPVYPFF

SEQ ID NO: 6926 - protein, 9 aa, Homo sapiens
ERLPRPVYP

SEQ ID NO: 6927 - protein, 9 aa, Homo sapiens
SSNQRVDLY

SEQ ID NO: 6928 - protein, 9 aa, Homo sapiens
VPVRDIPAF

SEQ ID NO: 6929 - protein, 9 aa, Homo sapiens
TRNVPVRDI

SEQ ID NO: 6930 - protein, 9 aa, Homo sapiens
TPFSVMIAC

SEQ ID NO: 6931 - protein, 9 aa, Homo sapiens
KPSSTCGPF

SEQ ID NO: 6932 - protein, 9 aa, Homo sapiens
GPFRTLDTM

SEQ ID NO: 6933 - protein, 9 aa, Homo sapiens
QAASPMPLF

SEQ ID NO: 6934 - protein, 9 aa, Homo sapiens
FRHQRIHTG

SEQ ID NO: 6935 - protein, 9 aa, Homo sapiens
MVFEDVAIH

SEQ ID NO: 6936 - protein, 9 aa, Homo sapiens
RPFKQRRSF

SEQ ID NO: 6937 - protein, 9 aa, Homo sapiens
VHTLNVLVQ

SEQ ID NO: 6938 - protein, 9 aa, Homo sapiens
ESMAITEAF

SEQ ID NO: 6939 - protein, 9 aa, Homo sapiens
ESMAITEAF

SEQ ID NO: 6940 - protein, 9 aa, Homo sapiens
YSIVRGNEM

SEQ ID NO: 6941 - protein, 9 aa, Homo sapiens
VRGNEMNLF

SEQ ID NO: 6942 - protein, 9 aa, Homo sapiens
FPSVQSNAA

SEQ ID NO: 6943 - protein, 9 aa, Homo sapiens
SVQSNAAAY

SEQ ID NO: 6944 - protein, 9 aa, Homo sapiens
ERSEKSVEI

SEQ ID NO: 6945 - protein, 9 aa, Homo sapiens
VTRDDAGNY

SEQ ID NO: 6946 - protein, 9 aa, Homo sapiens
QLLEIMCNY

SEQ ID NO: 6947 - protein, 9 aa, Homo sapiens
VHHRNPLSL

SEQ ID NO: 6948 - protein, 9 aa, Homo sapiens
HPDAAEILR

SEQ ID NO: 6949 - protein, 9 aa, Homo sapiens
FTYYPNPVF

SEQ ID NO: 6950 - protein, 9 aa, Homo sapiens
YPNPVFEAF

SEQ ID NO: 6951 - protein, 9 aa, Homo sapiens
YPPRGLPPY

SEQ ID NO: 6952 - protein, 9 aa, Homo sapiens
NDMGSIPEH

SEQ ID NO: 6953 - protein, 9 aa, Homo sapiens
VADADYSEL

SEQ ID NO: 6954 - protein, 9 aa, Homo sapiens
FPQVGRTAL

SEQ ID NO: 6955 - protein, 9 aa, Homo sapiens
YNFPQVGRT

SEQ ID NO: 6956 - protein, 9 aa, Homo sapiens
TAEHFQEAM

SEQ ID NO: 6957 - protein, 9 aa, Homo sapiens
DSSRKPRAF

SEQ ID NO: 6958 - protein, 9 aa, Homo sapiens
SSLHFMVEV

SEQ ID NO: 6959 - protein, 9 aa, Homo sapiens
SSLHFMVEV

SEQ ID NO: 6960 - protein, 9 aa, Homo sapiens
SHSAGSPLF

SEQ ID NO: 6961 - protein, 9 aa, Homo sapiens
LLSGLLYPG

SEQ ID NO: 6962 - protein, 9 aa, Homo sapiens
LLYPGLQAL

SEQ ID NO: 6963 - protein, 9 aa, Homo sapiens
GYRLVGHSM

SEQ ID NO: 6964 - protein, 9 aa, Homo sapiens
YFKEALDRW

SEQ ID NO: 6965 - protein, 9 aa, Homo sapiens
EALDRWAQF

SEQ ID NO: 6966 - protein, 9 aa, Homo sapiens
VNLEAPEPG

SEQ ID NO: 6967 - protein, 9 aa, Homo sapiens
EAPEPGVEV

SEQ ID NO: 6968 - protein, 9 aa, Homo sapiens
APEPGVEVI

SEQ ID NO: 6969 - protein, 9 aa, Homo sapiens
IWDLHISTL

SEQ ID NO: 6970 - protein, 9 aa, Homo sapiens
KLNHVAAGL

SEQ ID NO: 6971 - protein, 9 aa, Homo sapiens
VAFPITMLL

SEQ ID NO: 6972 - protein, 9 aa, Homo sapiens
GSVSVAFPI

SEQ ID NO: 6973 - protein, 9 aa, Homo sapiens
VAFPITMLL

SEQ ID NO: 6974 - protein, 9 aa, Homo sapiens
VSVAFPITM

SEQ ID NO: 6975 - protein, 9 aa, Homo sapiens
VAFPITMLL

SEQ ID NO: 6976 - protein, 9 aa, Homo sapiens
VYAMCVETI

SEQ ID NO: 6977 - protein, 9 aa, Homo sapiens
LIAHGFFSV

SEQ ID NO: 6978 - protein, 9 aa, Homo sapiens
IAHGFFSVY

SEQ ID NO: 6979 - protein, 9 aa, Homo sapiens
VYAMCVETI

SEQ ID NO: 6980 - protein, 9 aa, Homo sapiens
IVLEYLDHR

SEQ ID NO: 6981 - protein, 9 aa, Homo sapiens
MYSDQKPTL

SEQ ID NO: 6982 - protein, 9 aa, Homo sapiens
YSDQKPTLV

SEQ ID NO: 6983 - protein, 9 aa, Homo sapiens
YYDVVKNPM

SEQ ID NO: 6984 - protein, 9 aa, Homo sapiens
LHNYYDVVK

SEQ ID NO: 6985 - protein, 9 aa, Homo sapiens
YYDVVKNPM

SEQ ID NO: 6986 - protein, 9 aa, Homo sapiens
ILSQFMDTL

SEQ ID NO: 6987 - protein, 9 aa, Homo sapiens
ILSQFMDTL

SEQ ID NO: 6988 - protein, 9 aa, Homo sapiens
KCIDHPNGY

SEQ ID NO: 6989 - protein, 9 aa, Homo sapiens
QTLDSRPSV

SEQ ID NO: 6990 - protein, 9 aa, Homo sapiens
PLSRWLRSV

SEQ ID NO: 6991 - protein, 9 aa, Homo sapiens
MIDPPRAAV

SEQ ID NO: 6992 - protein, 9 aa, Homo sapiens
QWDRTLKPL

SEQ ID NO: 6993 - protein, 9 aa, Homo sapiens
SKYDTLKII

SEQ ID NO: 6994 - protein, 9 aa, Homo sapiens
DTLKIIKHL

SEQ ID NO: 6995 - protein, 9 aa, Homo sapiens
MPRRNKGMR

SEQ ID NO: 6996 - protein, 9 aa, Homo sapiens
RQWHSAVVI

SEQ ID NO: 6997 - protein, 9 aa, Homo sapiens
YIRQWHSAV

SEQ ID NO: 6998 - protein, 9 aa, Homo sapiens
RQWHSAVVI

SEQ ID NO: 6999 - protein, 9 aa, Homo sapiens
RQWHSAVVI

SEQ ID NO: 7000 - protein, 9 aa, Homo sapiens
YIRQWHSAV

SEQ ID NO: 7001 - protein, 9 aa, Homo sapiens
RQWHSAVVI

SEQ ID NO: 7002 - protein, 9 aa, Homo sapiens
KPDPPQGPM

SEQ ID NO: 7003 - protein, 9 aa, Homo sapiens
CQYEFRVTA

SEQ ID NO: 7004 - protein, 9 aa, Homo sapiens
YEFRVTAVA

SEQ ID NO: 7005 - protein, 9 aa, Homo sapiens
KLMLEFHTL

SEQ ID NO: 7006 - protein, 9 aa, Homo sapiens
LMLEFHTLL

SEQ ID NO: 7007 - protein, 9 aa, Homo sapiens
LMLEFHTLL

SEQ ID NO: 7008 - protein, 9 aa, Homo sapiens
VTFLEASRF

SEQ ID NO: 7009 - protein, 9 aa, Homo sapiens
REYSRYLHA

SEQ ID NO: 7010 - protein, 9 aa, Homo sapiens
YSRYLHAHL

SEQ ID NO: 7011 - protein, 9 aa, Homo sapiens
QALNMSAAL

SEQ ID NO: 7012 - protein, 9 aa, Homo sapiens
YFQPFLGRI

SEQ ID NO: 7013 - protein, 9 aa, Homo sapiens
YFQPFLGRI

SEQ ID NO: 7014 - protein, 9 aa, Homo sapiens
QPFLGRIEI

SEQ ID NO: 7015 - protein, 9 aa, Homo sapiens
RLCRGLVSV

SEQ ID NO: 7016 - protein, 9 aa, Homo sapiens
RLCRGLVSV

SEQ ID NO: 7017 - protein, 9 aa, Homo sapiens
KICGLMATF

SEQ ID NO: 7018 - protein, 9 aa, Homo sapiens
HFFCEAPVL

SEQ ID NO: 7019 - protein, 9 aa, Homo sapiens
FFCEAPVLV

SEQ ID NO: 7020 - protein, 9 aa, Homo sapiens
IQMFFHLTL

SEQ ID NO: 7021 - protein, 9 aa, Homo sapiens
LTLAGAEVF

SEQ ID NO: 7022 - protein, 9 aa, Homo sapiens
IQMFFHLTL

SEQ ID NO: 7023 - protein, 9 aa, Homo sapiens
LTLAGAEVF

SEQ ID NO: 7024 - protein, 9 aa, Homo sapiens
SNYSVYADF

SEQ ID NO: 7025 - protein, 9 aa, Homo sapiens
NYSVYADFI

SEQ ID NO: 7026 - protein, 9 aa, Homo sapiens
ADFILLGLF

SEQ ID NO: 7027 - protein, 9 aa, Homo sapiens
QSNYSVYAD

SEQ ID NO: 7028 - protein, 9 aa, Homo sapiens
YSVYADFIL

SEQ ID NO: 7029 - protein, 9 aa, Homo sapiens
SVYADFILL

SEQ ID NO: 7030 - protein, 9 aa, Homo sapiens
YADFILLGL

SEQ ID NO: 7031 - protein, 9 aa, Homo sapiens
RYQLQRGVV

SEQ ID NO: 7032 - protein, 9 aa, Homo sapiens
IALRYQLQR

SEQ ID NO: 7033 - protein, 9 aa, Homo sapiens
YQLQRGVVV

SEQ ID NO: 7034 - protein, 9 aa, Homo sapiens
RTHLVSEVF

SEQ ID NO: 7035 - protein, 9 aa, Homo sapiens
EAGETGRII

SEQ ID NO: 7036 - protein, 9 aa, Homo sapiens
EAVDDITSI

SEQ ID NO: 7037 - protein, 9 aa, Homo sapiens
FTSDSAVSI

SEQ ID NO: 7038 - protein, 9 aa, Homo sapiens
FDFTSDSAV

SEQ ID NO: 7039 - protein, 9 aa, Homo sapiens
FTSDSAVSI

SEQ ID NO: 7040 - protein, 9 aa, Homo sapiens
QYTHVNEVW

SEQ ID NO: 7041 - protein, 9 aa, Homo sapiens
PQYTHVNEV

SEQ ID NO: 7042 - protein, 9 aa, Homo sapiens
SYTANLAAF

SEQ ID NO: 7043 - protein, 9 aa, Homo sapiens
YTANLAAFL

SEQ ID NO: 7044 - protein, 9 aa, Homo sapiens
TASSLVWPL

SEQ ID NO: 7045 - protein, 9 aa, Homo sapiens
LVWPLPAHL

SEQ ID NO: 7046 - protein, 9 aa, Homo sapiens
DMRPFFEEY

SEQ ID NO: 7047 - protein, 9 aa, Homo sapiens
VSYVNLSSM

SEQ ID NO: 7048 - protein, 9 aa, Homo sapiens
SMEDGIKHV

SEQ ID NO: 7049 - protein, 9 aa, Homo sapiens
SMEDGIKHV

SEQ ID NO: 7050 - protein, 9 aa, Homo sapiens
VLLQEMVFF

SEQ ID NO: 7051 - protein, 9 aa, Homo sapiens
ISFPYGQCL

SEQ ID NO: 7052 - protein, 9 aa, Homo sapiens
FPYGQCLEW

SEQ ID NO: 7053 - protein, 9 aa, Homo sapiens
RHHTAINFI

SEQ ID NO: 7054 - protein, 9 aa, Homo sapiens
RHHTAINFI

SEQ ID NO: 7055 - protein, 9 aa, Homo sapiens
LIVMHRSLV

SEQ ID NO: 7056 - protein, 9 aa, Homo sapiens
LPADCQIHL

SEQ ID NO: 7057 - protein, 9 aa, Homo sapiens
RHFLTLAPI

SEQ ID NO: 7058 - protein, 9 aa, Homo sapiens
RHFLTLAPI

SEQ ID NO: 7059 - protein, 9 aa, Homo sapiens
FLTLAPIKI

SEQ ID NO: 7060 - protein, 9 aa, Homo sapiens
FARKPISII

SEQ ID NO: 7061 - protein, 9 aa, Homo sapiens
VYTNSSNTL

SEQ ID NO: 7062 - protein, 9 aa, Homo sapiens
LYWELNQAV

SEQ ID NO: 7063 - protein, 9 aa, Homo sapiens
YTNSSNTLY

SEQ ID NO: 7064 - protein, 9 aa, Homo sapiens
LYWELNQAV

SEQ ID NO: 7065 - protein, 9 aa, Homo sapiens
YESKSLEEL

SEQ ID NO: 7066 - protein, 9 aa, Homo sapiens
SLHEPMYYF

SEQ ID NO: 7067 - protein, 9 aa, Homo sapiens
LARNFGKEF

SEQ ID NO: 7068 - protein, 9 aa, Homo sapiens
FGKEFTPQM

SEQ ID NO: 7069 - protein, 9 aa, Homo sapiens
FYGTASMTY

SEQ ID NO: 7070 - protein, 9 aa, Homo sapiens
YGTASMTYL

SEQ ID NO: 7071 - protein, 9 aa, Homo sapiens
QASSGQARM

SEQ ID NO: 7072 - protein, 9 aa, Homo sapiens
GYLEVIGFT

SEQ ID NO: 7073 - protein, 9 aa, Homo sapiens
FTMTSLAAL

SEQ ID NO: 7074 - protein, 9 aa, Homo sapiens
EARSRLQQL

SEQ ID NO: 7075 - protein, 9 aa, Homo sapiens
AFGVCNNYW

SEQ ID NO: 7076 - protein, 9 aa, Homo sapiens
WAFGVCNNY

SEQ ID NO: 7077 - protein, 9 aa, Homo sapiens
SYFCILITV

SEQ ID NO: 7078 - protein, 9 aa, Homo sapiens
YFCILITVL

SEQ ID NO: 7079 - protein, 9 aa, Homo sapiens
LQLHTPMYF

SEQ ID NO: 7080 - protein, 9 aa, Homo sapiens
QLHTPMYFF

SEQ ID NO: 7081 - protein, 9 aa, Homo sapiens
LHTPMYFFL

SEQ ID NO: 7082 - protein, 9 aa, Homo sapiens
YSLRNTDVI

SEQ ID NO: 7083 - protein, 9 aa, Homo sapiens
YSLRNTDVI

SEQ ID NO: 7084 - protein, 9 aa, Homo sapiens
VKSAFKKVV

SEQ ID NO: 7085 - protein, 9 aa, Homo sapiens
VFAPYPSHF

SEQ ID NO: 7086 - protein, 9 aa, Homo sapiens
YPSHFNPAI

SEQ ID NO: 7087 - protein, 9 aa, Homo sapiens
ELLTGASPF

SEQ ID NO: 7088 - protein, 9 aa, Homo sapiens
FMHEEAGVV

SEQ ID NO: 7089 - protein, 9 aa, Homo sapiens
KMYHINETR

SEQ ID NO: 7090 - protein, 9 aa, Homo sapiens
YHINETRGL

SEQ ID NO: 7091 - protein, 9 aa, Homo sapiens
QGAQELLEF

SEQ ID NO: 7092 - protein, 9 aa, Homo sapiens
FSVHHQPTV

SEQ ID NO: 7093 - protein, 9 aa, Homo sapiens
KINPKTGGI

SEQ ID NO: 7094 - protein, 9 aa, Homo sapiens
KTGGISVSE

SEQ ID NO: 7095 - protein, 9 aa, Homo sapiens
PYYLVKESL

SEQ ID NO: 7096 - protein, 9 aa, Homo sapiens
LQDSAMKLV

SEQ ID NO: 7097 - protein, 9 aa, Homo sapiens
RPRGPSPLV

SEQ ID NO: 7098 - protein, 9 aa, Homo sapiens
QTFSLNETC

SEQ ID NO: 7099 - protein, 9 aa, Homo sapiens
QPRDMVAVV

SEQ ID NO: 7100 - protein, 9 aa, Homo sapiens
TYKGFTEAV

SEQ ID NO: 7101 - protein, 9 aa, Homo sapiens
AATRQCSTV

SEQ ID NO: 7102 - protein, 9 aa, Homo sapiens
DAFWWAVVS

SEQ ID NO: 7103 - protein, 9 aa, Homo sapiens
VPKKLDVSI

SEQ ID NO: 7104 - protein, 9 aa, Homo sapiens
KDSQRNSPF

SEQ ID NO: 7105 - protein, 9 aa, Homo sapiens
CQYVGADVL

SEQ ID NO: 7106 - protein, 9 aa, Homo sapiens
YVGADVLDL

SEQ ID NO: 7107 - protein, 9 aa, Homo sapiens
DVLDLAETM

SEQ ID NO: 7108 - protein, 9 aa, Homo sapiens
IHAKRVTIM

SEQ ID NO: 7109 - protein, 9 aa, Homo sapiens
SQLAGIPKM

SEQ ID NO: 7110 - protein, 9 aa, Homo sapiens
KVEEFRIRY

SEQ ID NO: 7111 - protein, 9 aa, Homo sapiens
FRIRYEDEI

SEQ ID NO: 7112 - protein, 9 aa, Homo sapiens
RLQEVTHSV

SEQ ID NO: 7113 - protein, 9 aa, Homo sapiens
VTHSVRIGF

SEQ ID NO: 7114 - protein, 9 aa, Homo sapiens
RLQEVTHSV

SEQ ID NO: 7115 - protein, 9 aa, Homo sapiens
FSSHCPFLM

SEQ ID NO: 7116 - protein, 9 aa, Homo sapiens
FLMGPIECL

SEQ ID NO: 7117 - protein, 9 aa, Homo sapiens
SWVTGFLII

SEQ ID NO: 7118 - protein, 9 aa, Homo sapiens
WVTGFLIIF

SEQ ID NO: 7119 - protein, 9 aa, Homo sapiens
GFLIIFPPL

SEQ ID NO: 7120 - protein, 9 aa, Homo sapiens
SSWVTGFLI

SEQ ID NO: 7121 - protein, 9 aa, Homo sapiens
FLIIFPPLV

SEQ ID NO: 7122 - protein, 9 aa, Homo sapiens
IIFPPLVMG

SEQ ID NO: 7123 - protein, 9 aa, Homo sapiens
IRFRTGPLV

SEQ ID NO: 7124 - protein, 9 aa, Homo sapiens
RTGPLVPSV

SEQ ID NO: 7125 - protein, 9 aa, Homo sapiens
ETTARELPI

SEQ ID NO: 7126 - protein, 9 aa, Homo sapiens
HHKDHFTKL

SEQ ID NO: 7127 - protein, 9 aa, Homo sapiens
RMRSLVVSW

SEQ ID NO: 7128 - protein, 9 aa, Homo sapiens
LTFISPEVI

SEQ ID NO: 7129 - protein, 9 aa, Homo sapiens
YIAGGGGTG

SEQ ID NO: 7130 - protein, 9 aa, Homo sapiens
RYGLVMTEA

SEQ ID NO: 7131 - protein, 9 aa, Homo sapiens
ATQRYGLVM

SEQ ID NO: 7132 - protein, 9 aa, Homo sapiens
LTLANGERI

SEQ ID NO: 7133 - protein, 9 aa, Homo sapiens
SYDPARYPR

SEQ ID NO: 7134 - protein, 9 aa, Homo sapiens
RYPRYLPEA

SEQ ID NO: 7135 - protein, 9 aa, Homo sapiens
RYLPEAYCL

SEQ ID NO: 7136 - protein, 9 aa, Homo sapiens
YPRYLPEAY

SEQ ID NO: 7137 - protein, 9 aa, Homo sapiens
SSLTIADAF

SEQ ID NO: 7138 - protein, 9 aa, Homo sapiens
AFREEMKIF

SEQ ID NO: 7139 - protein, 9 aa, Homo sapiens
KAFREEMKI

SEQ ID NO: 7140 - protein, 9 aa, Homo sapiens
HVLNAWGAF

SEQ ID NO: 7141 - protein, 9 aa, Homo sapiens
HVLNAWGAF

SEQ ID NO: 7142 - protein, 9 aa, Homo sapiens
QEHPSIRTL

SEQ ID NO: 7143 - protein, 9 aa, Homo sapiens
LVIGTTLHV

SEQ ID NO: 7144 - protein, 9 aa, Homo sapiens
HAQEKYEEF

SEQ ID NO: 7145 - protein, 9 aa, Homo sapiens
KYEEFESVL

SEQ ID NO: 7146 - protein, 9 aa, Homo sapiens
HAQEKYEEF

SEQ ID NO: 7147 - protein, 9 aa, Homo sapiens
EKYEEFESV

SEQ ID NO: 7148 - protein, 9 aa, Homo sapiens
FFGRWELQI

SEQ ID NO: 7149 - protein, 9 aa, Homo sapiens
FVQEHRLVL

SEQ ID NO: 7150 - protein, 9 aa, Homo sapiens
HCAPGDLIY

SEQ ID NO: 7151 - protein, 9 aa, Homo sapiens
SLMQLESRW

SEQ ID NO: 7152 - protein, 9 aa, Homo sapiens
LESRWRQHF

SEQ ID NO: 7153 - protein, 9 aa, Homo sapiens
YVEAAPESL

SEQ ID NO: 7154 - protein, 9 aa, Homo sapiens
EAAPESLVV

SEQ ID NO: 7155 - protein, 9 aa, Homo sapiens
AAPESLVVF

SEQ ID NO: 7156 - protein, 9 aa, Homo sapiens
YYLKTVGHL

SEQ ID NO: 7157 - protein, 9 aa, Homo sapiens
YYLKTVGHL

SEQ ID NO: 7158 - protein, 9 aa, Homo sapiens
IKIDGVEDM

SEQ ID NO: 7159 - protein, 9 aa, Homo sapiens
LMPPNLWSL

SEQ ID NO: 7160 - protein, 9 aa, Homo sapiens
RYHVRREDL

SEQ ID NO: 7161 - protein, 9 aa, Homo sapiens
TFPEELVMI

SEQ ID NO: 7162 - protein, 9 aa, Homo sapiens
CANTFPEEL

SEQ ID NO: 7163 - protein, 9 aa, Homo sapiens
RATPPPGIM

SEQ ID NO: 7164 - protein, 9 aa, Homo sapiens
KRAAAKHLI

SEQ ID NO: 7165 - protein, 9 aa, Homo sapiens
QYRKQSMPR

SEQ ID NO: 7166 - protein, 9 aa, Homo sapiens
FDNSGIQYR

SEQ ID NO: 7167 - protein, 9 aa, Homo sapiens
DAADFIRAG

SEQ ID NO: 7168 - protein, 9 aa, Homo sapiens
FIRAGRDIF

SEQ ID NO: 7169 - protein, 9 aa, Homo sapiens
FSQKQIILL

SEQ ID NO: 7170 - protein, 9 aa, Homo sapiens
FFMSLLNFL

SEQ ID NO: 7171 - protein, 9 aa, Homo sapiens
SLLNFLNNF

SEQ ID NO: 7172 - protein, 9 aa, Homo sapiens
SLLNFLNNF

SEQ ID NO: 7173 - protein, 9 aa, Homo sapiens
FFMSLLNFL

SEQ ID NO: 7174 - protein, 9 aa, Homo sapiens
FYVNNNWYI

SEQ ID NO: 7175 - protein, 9 aa, Homo sapiens
YVNNNWYIF

SEQ ID NO: 7176 - protein, 9 aa, Homo sapiens
YVNNNWYIF

SEQ ID NO: 7177 - protein, 9 aa, Homo sapiens
LFYVNNNWY

SEQ ID NO: 7178 - protein, 9 aa, Homo sapiens
FYVNNNWYI

SEQ ID NO: 7179 - protein, 9 aa, Homo sapiens
YVNNNWYIF

SEQ ID NO: 7180 - protein, 9 aa, Homo sapiens
LALILFVSY

SEQ ID NO: 7181 - protein, 9 aa, Homo sapiens
GLFRAAGHL

SEQ ID NO: 7182 - protein, 9 aa, Homo sapiens
LFRAAGHLL

SEQ ID NO: 7183 - protein, 9 aa, Homo sapiens
GFSDPYCML

SEQ ID NO: 7184 - protein, 9 aa, Homo sapiens
YLPGRPTSM

SEQ ID NO: 7185 - protein, 9 aa, Homo sapiens
DWYGSAVPL

SEQ ID NO: 7186 - protein, 9 aa, Homo sapiens
RAPGSTWAI

SEQ ID NO: 7187 - protein, 9 aa, Homo sapiens
RAPGSTWAI

SEQ ID NO: 7188 - protein, 9 aa, Homo sapiens
RAPGSTWAI

SEQ ID NO: 7189 - protein, 9 aa, Homo sapiens
STLLLNSSF

SEQ ID NO: 7190 - protein, 9 aa, Homo sapiens
AAENCIGIR

SEQ ID NO: 7191 - protein, 9 aa, Homo sapiens
RQGPWAALF

SEQ ID NO: 7192 - protein, 9 aa, Homo sapiens
RQGPWAALF

SEQ ID NO: 7193 - protein, 9 aa, Homo sapiens
RQGPWAALF

SEQ ID NO: 7194 - protein, 9 aa, Homo sapiens
WAALFVRTM

SEQ ID NO: 7195 - protein, 9 aa, Homo sapiens
RSHSMETMV

SEQ ID NO: 7196 - protein, 9 aa, Homo sapiens
FNPPDLDIM

SEQ ID NO: 7197 - protein, 9 aa, Homo sapiens
LVLLFVSTI

SEQ ID NO: 7198 - protein, 9 aa, Homo sapiens
VAVLVLLFV

SEQ ID NO: 7199 - protein, 9 aa, Homo sapiens
LVLLFVSTI

SEQ ID NO: 7200 - protein, 9 aa, Homo sapiens
FMQAPEQEM

SEQ ID NO: 7201 - protein, 9 aa, Homo sapiens
MQAPEQEMV

SEQ ID NO: 7202 - protein, 9 aa, Homo sapiens
VFYPEKQEI

SEQ ID NO: 7203 - protein, 9 aa, Homo sapiens
VFYPEKQEI

SEQ ID NO: 7204 - protein, 9 aa, Homo sapiens
YPEKQEITL

SEQ ID NO: 7205 - protein, 9 aa, Homo sapiens
FINGPNNAH

SEQ ID NO: 7206 - protein, 9 aa, Homo sapiens
SMRTVDCPF

SEQ ID NO: 7207 - protein, 9 aa, Homo sapiens
RTVDCPFTV

SEQ ID NO: 7208 - protein, 9 aa, Homo sapiens
LYALDRKAV

SEQ ID NO: 7209 - protein, 9 aa, Homo sapiens
YALDRKAVA

SEQ ID NO: 7210 - protein, 9 aa, Homo sapiens
VAKDNFEIL

SEQ ID NO: 7211 - protein, 9 aa, Homo sapiens
QADLEVAAQ

SEQ ID NO: 7212 - protein, 9 aa, Homo sapiens
CAASSLPRV

SEQ ID NO: 7213 - protein, 9 aa, Homo sapiens
RVDDVLASL

SEQ ID NO: 7214 - protein, 9 aa, Homo sapiens
EYLEVQRQL

SEQ ID NO: 7215 - protein, 9 aa, Homo sapiens
QRQLAIQRL

SEQ ID NO: 7216 - protein, 9 aa, Homo sapiens
KQEYLEVQR

SEQ ID NO: 7217 - protein, 9 aa, Homo sapiens
RTQADLDSL

SEQ ID NO: 7218 - protein, 9 aa, Homo sapiens
YYSGDSLGW

SEQ ID NO: 7219 - protein, 9 aa, Homo sapiens
VVHTETKTI

SEQ ID NO: 7220 - protein, 9 aa, Homo sapiens
HTETKTITY

SEQ ID NO: 7221 - protein, 9 aa, Homo sapiens
KADAVVPEL

SEQ ID NO: 7222 - protein, 9 aa, Homo sapiens
PHLDFITIL

SEQ ID NO: 7223 - protein, 9 aa, Homo sapiens
LLFPHLDFI

SEQ ID NO: 7224 - protein, 9 aa, Homo sapiens
FPHLDFITI

SEQ ID NO: 7225 - protein, 9 aa, Homo sapiens
PHLDFITIL

SEQ ID NO: 7226 - protein, 9 aa, Homo sapiens
EQLPPESSY

SEQ ID NO: 7227 - protein, 9 aa, Homo sapiens
IANFAEQIG

SEQ ID NO: 7228 - protein, 9 aa, Homo sapiens
CQCSHLSSF

SEQ ID NO: 7229 - protein, 9 aa, Homo sapiens
ASVSALSLI

SEQ ID NO: 7230 - protein, 9 aa, Homo sapiens
SASVSALSL

SEQ ID NO: 7231 - protein, 9 aa, Homo sapiens
SVSALSLII

SEQ ID NO: 7232 - protein, 9 aa, Homo sapiens
QRGDFPGTY

SEQ ID NO: 7233 - protein, 9 aa, Homo sapiens
KAFNSSSTL

SEQ ID NO: 7234 - protein, 9 aa, Homo sapiens
KAFNSSSTL

SEQ ID NO: 7235 - protein, 9 aa, Homo sapiens
IAAPKPDLI

SEQ ID NO: 7236 - protein, 9 aa, Homo sapiens
LCIGLLTSV

SEQ ID NO: 7237 - protein, 9 aa, Homo sapiens
YIIFRGSDI

SEQ ID NO: 7238 - protein, 9 aa, Homo sapiens
YIIFRGSDI

SEQ ID NO: 7239 - protein, 9 aa, Homo sapiens
NWICFYSNI

SEQ ID NO: 7240 - protein, 9 aa, Homo sapiens
CFYSNIFRW

SEQ ID NO: 7241 - protein, 9 aa, Homo sapiens
NIFRWETTI

SEQ ID NO: 7242 - protein, 9 aa, Homo sapiens
NIFRWETTI

SEQ ID NO: 7243 - protein, 9 aa, Homo sapiens
QAVARSVLV

SEQ ID NO: 7244 - protein, 9 aa, Homo sapiens
KVFSWSSYL

SEQ ID NO: 7245 - protein, 9 aa, Homo sapiens
KVFSWSSYL

SEQ ID NO: 7246 - protein, 9 aa, Homo sapiens
LVPEAPRRV

SEQ ID NO: 7247 - protein, 9 aa, Homo sapiens
AYMKSEDPL

SEQ ID NO: 7248 - protein, 9 aa, Homo sapiens
SAAKGVAAY

SEQ ID NO: 7249 - protein, 9 aa, Homo sapiens
IFNNYRNDF

SEQ ID NO: 7250 - protein, 9 aa, Homo sapiens
CVNLSDNEL

SEQ ID NO: 7251 - protein, 9 aa, Homo sapiens
LQDDGIKLL

SEQ ID NO: 7252 - protein, 9 aa, Homo sapiens
STSNPVDLF

SEQ ID NO: 7253 - protein, 9 aa, Homo sapiens
STSNPVDLF

SEQ ID NO: 7254 - protein, 9 aa, Homo sapiens
QTLNAKNGL

SEQ ID NO: 7255 - protein, 9 aa, Homo sapiens
RVHSGERPF

SEQ ID NO: 7256 - protein, 9 aa, Homo sapiens
RVHSGERPF

SEQ ID NO: 7257 - protein, 9 aa, Homo sapiens
RYIEFHSQS

SEQ ID NO: 7258 - protein, 9 aa, Homo sapiens
FHSQSGFYY

SEQ ID NO: 7259 - protein, 9 aa, Homo sapiens
YPDVNHAKV

SEQ ID NO: 7260 - protein, 9 aa, Homo sapiens
FITEGQIYV

SEQ ID NO: 7261 - protein, 9 aa, Homo sapiens
IQWDWSTYL

SEQ ID NO: 7262 - protein, 9 aa, Homo sapiens
FIQWDWSTY

SEQ ID NO: 7263 - protein, 9 aa, Homo sapiens
IQWDWSTYL

SEQ ID NO: 7264 - protein, 9 aa, Homo sapiens
SGILEAAGF

SEQ ID NO: 7265 - protein, 9 aa, Homo sapiens
GRDHMMDAI

SEQ ID NO: 7266 - protein, 9 aa, Homo sapiens
THVGFPENL

SEQ ID NO: 7267 - protein, 9 aa, Homo sapiens
HYHEVMEEI

SEQ ID NO: 7268 - protein, 9 aa, Homo sapiens
MAFNYHYHE

SEQ ID NO: 7269 - protein, 9 aa, Homo sapiens
FNYHYHEVM

SEQ ID NO: 7270 - protein, 9 aa, Homo sapiens
GFHVCAAGW

SEQ ID NO: 7271 - protein, 9 aa, Homo sapiens
EYKKDFEKW

SEQ ID NO: 7272 - protein, 9 aa, Homo sapiens
DFEKWKTKF

SEQ ID NO: 7273 - protein, 9 aa, Homo sapiens
RSGCSSQSI

SEQ ID NO: 7274 - protein, 9 aa, Homo sapiens
IFFVVVSFL

SEQ ID NO: 7275 - protein, 9 aa, Homo sapiens
FFVVVSFLF

SEQ ID NO: 7276 - protein, 9 aa, Homo sapiens
MIFFVVVSF

SEQ ID NO: 7277 - protein, 9 aa, Homo sapiens
VVVSFLFSF

SEQ ID NO: 7278 - protein, 9 aa, Homo sapiens
MIFFVVVSF

SEQ ID NO: 7279 - protein, 9 aa, Homo sapiens
LDLDSISKI

SEQ ID NO: 7280 - protein, 9 aa, Homo sapiens
DSISKILSV

SEQ ID NO: 7281 - protein, 9 aa, Homo sapiens
DYMYDEEYL

SEQ ID NO: 7282 - protein, 9 aa, Homo sapiens
HPNLHGPEI

SEQ ID NO: 7283 - protein, 9 aa, Homo sapiens
FEVPARANF

SEQ ID NO: 7284 - protein, 9 aa, Homo sapiens
QVIQPDKSI

SEQ ID NO: 7285 - protein, 9 aa, Homo sapiens
DADLNDERV

SEQ ID NO: 7286 - protein, 9 aa, Homo sapiens
FVVPSPVES

SEQ ID NO: 7287 - protein, 9 aa, Homo sapiens
FVVPSPVES

SEQ ID NO: 7288 - protein, 9 aa, Homo sapiens
EYRTTTGTW

SEQ ID NO: 7289 - protein, 9 aa, Homo sapiens
EAVDRRNPA

SEQ ID NO: 7290 - protein, 9 aa, Homo sapiens
QHARVLQYR

SEQ ID NO: 7291 - protein, 9 aa, Homo sapiens
QYRELLDAL

SEQ ID NO: 7292 - protein, 9 aa, Homo sapiens
VPFLHAQRY

SEQ ID NO: 7293 - protein, 9 aa, Homo sapiens
PTQTPTQTI

SEQ ID NO: 7294 - protein, 9 aa, Homo sapiens
EMLHSGTLV

SEQ ID NO: 7295 - protein, 9 aa, Homo sapiens
YFGALFKAI

SEQ ID NO: 7296 - protein, 9 aa, Homo sapiens
ALFKAISAF

SEQ ID NO: 7297 - protein, 9 aa, Homo sapiens
IAPEGYAAY

SEQ ID NO: 7298 - protein, 9 aa, Homo sapiens
LVGETSVTV

SEQ ID NO: 7299 - protein, 9 aa, Homo sapiens
SWLGEAQWL

SEQ ID NO: 7300 - protein, 9 aa, Homo sapiens
QWLALVSLF

SEQ ID NO: 7301 - protein, 9 aa, Homo sapiens
AQWLALVSL

SEQ ID NO: 7302 - protein, 9 aa, Homo sapiens
VARKSVLVV

SEQ ID NO: 7303 - protein, 9 aa, Homo sapiens
SRLHNKPTF

SEQ ID NO: 7304 - protein, 9 aa, Homo sapiens
YALMKANPL

SEQ ID NO: 7305 - protein, 9 aa, Homo sapiens
KFGAQGSGF

SEQ ID NO: 7306 - protein, 9 aa, Homo sapiens
TKEEQIFLL

SEQ ID NO: 7307 - protein, 9 aa, Homo sapiens
MTKEEQIFL

SEQ ID NO: 7308 - protein, 9 aa, Homo sapiens
PPEPGPDRV

SEQ ID NO: 7309 - protein, 9 aa, Homo sapiens
WYYFDDSNV

SEQ ID NO: 7310 - protein, 9 aa, Homo sapiens
YFDDSNVSL

SEQ ID NO: 7311 - protein, 9 aa, Homo sapiens
DAQCQTLPL

SEQ ID NO: 7312 - protein, 9 aa, Homo sapiens
QASEANLQA

SEQ ID NO: 7313 - protein, 9 aa, Homo sapiens
AAQDFVRGF

SEQ ID NO: 7314 - protein, 9 aa, Homo sapiens
RAVAITVPL

SEQ ID NO: 7315 - protein, 9 aa, Homo sapiens
RAVAITVPL

SEQ ID NO: 7316 - protein, 9 aa, Homo sapiens
VAITVPLVV

SEQ ID NO: 7317 - protein, 9 aa, Homo sapiens
QAHQKKGSF

SEQ ID NO: 7318 - protein, 9 aa, Homo sapiens
AVHEFAKEI

SEQ ID NO: 7319 - protein, 9 aa, Homo sapiens
MTFKKDYQY

SEQ ID NO: 7320 - protein, 9 aa, Homo sapiens
MTFKKDYQY

SEQ ID NO: 7321 - protein, 9 aa, Homo sapiens
SLPSEPSEF

SEQ ID NO: 7322 - protein, 9 aa, Homo sapiens
LPSEPSEFV

SEQ ID NO: 7323 - protein, 9 aa, Homo sapiens
YATGVLKQL

SEQ ID NO: 7324 - protein, 9 aa, Homo sapiens
GSMPLFPSI

SEQ ID NO: 7325 - protein, 9 aa, Homo sapiens
GSMPLFPSI

SEQ ID NO: 7326 - protein, 9 aa, Homo sapiens
GSMPLFPSI

SEQ ID NO: 7327 - protein, 9 aa, Homo sapiens
MPLFPSIHL

SEQ ID NO: 7328 - protein, 9 aa, Homo sapiens
EWMGVMHGY

SEQ ID NO: 7329 - protein, 9 aa, Homo sapiens
VPSQFGSSV

SEQ ID NO: 7330 - protein, 9 aa, Homo sapiens
LMSPQGQVL

SEQ ID NO: 7331 - protein, 9 aa, Homo sapiens
LFMRAYLEV

SEQ ID NO: 7332 - protein, 9 aa, Homo sapiens
AFLMGGQSL

SEQ ID NO: 7333 - protein, 9 aa, Homo sapiens
FAFLMGGQS

SEQ ID NO: 7334 - protein, 9 aa, Homo sapiens
SVLACVIVV

SEQ ID NO: 7335 - protein, 9 aa, Homo sapiens
LACVIVVSL

SEQ ID NO: 7336 - protein, 9 aa, Homo sapiens
ICLHERNFV

SEQ ID NO: 7337 - protein, 9 aa, Homo sapiens
RNFVPGKSI

SEQ ID NO: 7338 - protein, 9 aa, Homo sapiens
GYAGQFFQP

SEQ ID NO: 7339 - protein, 9 aa, Homo sapiens
AFCVATWVF

SEQ ID NO: 7340 - protein, 9 aa, Homo sapiens
ATWVFTATQ

SEQ ID NO: 7341 - protein, 9 aa, Homo sapiens
TAFCVATWV

SEQ ID NO: 7342 - protein, 9 aa, Homo sapiens
NLKEEIAVL

SEQ ID NO: 7343 - protein, 9 aa, Homo sapiens
VWPTEYSHW

SEQ ID NO: 7344 - protein, 9 aa, Homo sapiens
SHWINMKTI

SEQ ID NO: 7345 - protein, 9 aa, Homo sapiens
HWINMKTIL

SEQ ID NO: 7346 - protein, 9 aa, Homo sapiens
LVWPTEYSH

SEQ ID NO: 7347 - protein, 9 aa, Homo sapiens
YSHWINMKT

SEQ ID NO: 7348 - protein, 9 aa, Homo sapiens
RALRTVITD

SEQ ID NO: 7349 - protein, 9 aa, Homo sapiens
RALRTVITD

SEQ ID NO: 7350 - protein, 9 aa, Homo sapiens
DSSYKENAM

SEQ ID NO: 7351 - protein, 9 aa, Homo sapiens
NVLGKPKKY

SEQ ID NO: 7352 - protein, 9 aa, Homo sapiens
WMPKATVQI

SEQ ID NO: 7353 - protein, 9 aa, Homo sapiens
LAWMPKATV

SEQ ID NO: 7354 - protein, 9 aa, Homo sapiens
ERDQLKESL

SEQ ID NO: 7355 - protein, 9 aa, Homo sapiens
QLKAKRKVV

SEQ ID NO: 7356 - protein, 9 aa, Homo sapiens
KAKRKVVKM

SEQ ID NO: 7357 - protein, 9 aa, Homo sapiens
EYLKQQVSL

SEQ ID NO: 7358 - protein, 9 aa, Homo sapiens
EADQIIEYL

SEQ ID NO: 7359 - protein, 9 aa, Homo sapiens
YLKQQVSLL

SEQ ID NO: 7360 - protein, 9 aa, Homo sapiens
FPLNLFNNL

SEQ ID NO: 7361 - protein, 9 aa, Homo sapiens
MELKTVKPI

SEQ ID NO: 7362 - protein, 9 aa, Homo sapiens
SFRTLIVLL

SEQ ID NO: 7363 - protein, 9 aa, Homo sapiens
KLRRSFRTL

SEQ ID NO: 7364 - protein, 9 aa, Homo sapiens
RSFRTLIVL

SEQ ID NO: 7365 - protein, 9 aa, Homo sapiens
SESNDNFLL

SEQ ID NO: 7366 - protein, 9 aa, Homo sapiens
FFAFMIGMF

SEQ ID NO: 7367 - protein, 9 aa, Homo sapiens
AFMIGMFIL

SEQ ID NO: 7368 - protein, 9 aa, Homo sapiens
IMVFFAFMI

SEQ ID NO: 7369 - protein, 9 aa, Homo sapiens
FIMVFFAFM

SEQ ID NO: 7370 - protein, 9 aa, Homo sapiens
IMVFFAFMI

SEQ ID NO: 7371 - protein, 9 aa, Homo sapiens
FAFMIGMFI

SEQ ID NO: 7372 - protein, 9 aa, Homo sapiens
FMIGMFILY

SEQ ID NO: 7373 - protein, 9 aa, Homo sapiens
MYFGEHLSF

SEQ ID NO: 7374 - protein, 9 aa, Homo sapiens
RMYFGEHLS

SEQ ID NO: 7375 - protein, 9 aa, Homo sapiens
EHLSFSGTL

SEQ ID NO: 7376 - protein, 9 aa, Homo sapiens
RMYFGEHLS

SEQ ID NO: 7377 - protein, 9 aa, Homo sapiens
DYDRSRCQF

SEQ ID NO: 7378 - protein, 9 aa, Homo sapiens
FCKRCLLGI

SEQ ID NO: 7379 - protein, 9 aa, Homo sapiens
ASFDGTIKV

SEQ ID NO: 7380 - protein, 9 aa, Homo sapiens
RVKALFSVL

SEQ ID NO: 7381 - protein, 9 aa, Homo sapiens
IAIVGLILL

SEQ ID NO: 7382 - protein, 9 aa, Homo sapiens
KLAIDGTII

SEQ ID NO: 7383 - protein, 9 aa, Homo sapiens
LAIDGTIIM

SEQ ID NO: 7384 - protein, 9 aa, Homo sapiens
YFTSPACKF

SEQ ID NO: 7385 - protein, 9 aa, Homo sapiens
YFTSPACKF

SEQ ID NO: 7386 - protein, 9 aa, Homo sapiens
FTSPACKFL

SEQ ID NO: 7387 - protein, 9 aa, Homo sapiens
FYTERAPAV

SEQ ID NO: 7388 - protein, 9 aa, Homo sapiens
YTERAPAVI

SEQ ID NO: 7389 - protein, 9 aa, Homo sapiens
TSFPESEGY

SEQ ID NO: 7390 - protein, 9 aa, Homo sapiens
ALLRAFQAW

SEQ ID NO: 7391 - protein, 9 aa, Homo sapiens
DAKNAVEEY

SEQ ID NO: 7392 - protein, 9 aa, Homo sapiens
ARDQGSPTL

SEQ ID NO: 7393 - protein, 9 aa, Homo sapiens
QARDQGSPT

SEQ ID NO: 7394 - protein, 9 aa, Homo sapiens
HVSPQAVLF

SEQ ID NO: 7395 - protein, 9 aa, Homo sapiens
RILGIVWGF

SEQ ID NO: 7396 - protein, 9 aa, Homo sapiens
RILGIVWGF

SEQ ID NO: 7397 - protein, 9 aa, Homo sapiens
RALRILGIV

SEQ ID NO: 7398 - protein, 9 aa, Homo sapiens
LAKEAAAVG

SEQ ID NO: 7399 - protein, 9 aa, Homo sapiens
AFSTCASHL

SEQ ID NO: 7400 - protein, 9 aa, Homo sapiens
STCASHLAI

SEQ ID NO: 7401 - protein, 9 aa, Homo sapiens
KSTAGNFLV

SEQ ID NO: 7402 - protein, 9 aa, Homo sapiens
RLPTVTAGW

SEQ ID NO: 7403 - protein, 9 aa, Homo sapiens
PLLALTWMS

SEQ ID NO: 7404 - protein, 9 aa, Homo sapiens
PLLALTWMS

SEQ ID NO: 7405 - protein, 9 aa, Homo sapiens
LALTWMSAV

SEQ ID NO: 7406 - protein, 9 aa, Homo sapiens
RGGERIPHV

SEQ ID NO: 7407 - protein, 9 aa, Homo sapiens
NSSRFGKFV

SEQ ID NO: 7408 - protein, 9 aa, Homo sapiens
IFMFFVLTL

SEQ ID NO: 7409 - protein, 9 aa, Homo sapiens
FMFFVLTLL

SEQ ID NO: 7410 - protein, 9 aa, Homo sapiens
IGLVLGGFI

SEQ ID NO: 7411 - protein, 9 aa, Homo sapiens
VSMAIGLVL

SEQ ID NO: 7412 - protein, 9 aa, Homo sapiens
LSHTFHRAL

SEQ ID NO: 7413 - protein, 9 aa, Homo sapiens
SVLCFTTPG

SEQ ID NO: 7414 - protein, 9 aa, Homo sapiens
SVLCFTTPG

SEQ ID NO: 7415 - protein, 9 aa, Homo sapiens
KSLIHTVLL

SEQ ID NO: 7416 - protein, 9 aa, Homo sapiens
IQKDKDIPA

SEQ ID NO: 7417 - protein, 9 aa, Homo sapiens
YLRPLRRHI

SEQ ID NO: 7418 - protein, 9 aa, Homo sapiens
HWHQLMKAI

SEQ ID NO: 7419 - protein, 9 aa, Homo sapiens
HWHQLMKAI

SEQ ID NO: 7420 - protein, 9 aa, Homo sapiens
KAAQIPSPL

SEQ ID NO: 7421 - protein, 9 aa, Homo sapiens
ELLDKAAQI

SEQ ID NO: 7422 - protein, 9 aa, Homo sapiens
KAAQIPSPL

SEQ ID NO: 7423 - protein, 9 aa, Homo sapiens
QILLNGNNI

SEQ ID NO: 7424 - protein, 9 aa, Homo sapiens
NGNNITMLV

SEQ ID NO: 7425 - protein, 9 aa, Homo sapiens
TVKNSAAPI

SEQ ID NO: 7426 - protein, 9 aa, Homo sapiens
RATTPSVTV

SEQ ID NO: 7427 - protein, 9 aa, Homo sapiens
TVKNSAAPI

SEQ ID NO: 7428 - protein, 9 aa, Homo sapiens
LPLGAACGV

SEQ ID NO: 7429 - protein, 9 aa, Homo sapiens
VSAAIPSSI

SEQ ID NO: 7430 - protein, 9 aa, Homo sapiens
RAVAVKGPV

SEQ ID NO: 7431 - protein, 9 aa, Homo sapiens
ASAALRRSF

SEQ ID NO: 7432 - protein, 9 aa, Homo sapiens
LARPASAAL

SEQ ID NO: 7433 - protein, 9 aa, Homo sapiens
ETADEKVIF

SEQ ID NO: 7434 - protein, 9 aa, Homo sapiens
IYFTCYDQL

SEQ ID NO: 7435 - protein, 9 aa, Homo sapiens
TCYDQLSAL

SEQ ID NO: 7436 - protein, 9 aa, Homo sapiens
CYDQLSALL

SEQ ID NO: 7437 - protein, 9 aa, Homo sapiens
TCYDQLSAL

SEQ ID NO: 7438 - protein, 9 aa, Homo sapiens
WAVSLQGKV

SEQ ID NO: 7439 - protein, 9 aa, Homo sapiens
FKSPDAFKV

SEQ ID NO: 7440 - protein, 9 aa, Homo sapiens
DAFKVSLPL

SEQ ID NO: 7441 - protein, 9 aa, Homo sapiens
LMERLPLTW

SEQ ID NO: 7442 - protein, 9 aa, Homo sapiens
ERLPLTWVL

SEQ ID NO: 7443 - protein, 9 aa, Homo sapiens
FLMERLPLT

SEQ ID NO: 7444 - protein, 9 aa, Homo sapiens
KFDRNRVRI

SEQ ID NO: 7445 - protein, 9 aa, Homo sapiens
RLQMINSKW

SEQ ID NO: 7446 - protein, 9 aa, Homo sapiens
LNSNRLQMI

SEQ ID NO: 7447 - protein, 9 aa, Homo sapiens
NPKSWYEDV

SEQ ID NO: 7448 - protein, 9 aa, Homo sapiens
YEDVEGCGI

SEQ ID NO: 7449 - protein, 9 aa, Homo sapiens
IEYLEDVKV

SEQ ID NO: 7450 - protein, 9 aa, Homo sapiens
SYDVALHRT

SEQ ID NO: 7451 - protein, 9 aa, Homo sapiens
VSSDCPNHF

SEQ ID NO: 7452 - protein, 9 aa, Homo sapiens
NPNVNAGII

SEQ ID NO: 7453 - protein, 9 aa, Homo sapiens
QVKRKRYTE

SEQ ID NO: 7454 - protein, 9 aa, Homo sapiens
YTEDLEFKI

SEQ ID NO: 7455 - protein, 9 aa, Homo sapiens
LHVKDLEFL

SEQ ID NO: 7456 - protein, 9 aa, Homo sapiens
FTPQLPGTV

SEQ ID NO: 7457 - protein, 9 aa, Homo sapiens
VSSENFDDY

SEQ ID NO: 7458 - protein, 9 aa, Homo sapiens
RVPPPPRAV

SEQ ID NO: 7459 - protein, 9 aa, Homo sapiens
VPPPPRAVI

SEQ ID NO: 7460 - protein, 9 aa, Homo sapiens
SALAAMQQF

SEQ ID NO: 7461 - protein, 9 aa, Homo sapiens
LANEEVRKL

SEQ ID NO: 7462 - protein, 9 aa, Homo sapiens
EILEGSQFV

SEQ ID NO: 7463 - protein, 9 aa, Homo sapiens
SNMELLLSG

SEQ ID NO: 7464 - protein, 9 aa, Homo sapiens
FWSKYKLSV

SEQ ID NO: 7465 - protein, 9 aa, Homo sapiens
SVPGNPHYL

SEQ ID NO: 7466 - protein, 9 aa, Homo sapiens
LSVPGNPHY

SEQ ID NO: 7467 - protein, 9 aa, Homo sapiens
TAKSATVKL

SEQ ID NO: 7468 - protein, 9 aa, Homo sapiens
KTEEAKLSF

SEQ ID NO: 7469 - protein, 9 aa, Homo sapiens
RFSEAFFYM

SEQ ID NO: 7470 - protein, 9 aa, Homo sapiens
FFYMEHQKL

SEQ ID NO: 7471 - protein, 9 aa, Homo sapiens
FFYMEHQKL

SEQ ID NO: 7472 - protein, 9 aa, Homo sapiens
YMEHQKLAV

SEQ ID NO: 7473 - protein, 9 aa, Homo sapiens
TFKDFYNCW

SEQ ID NO: 7474 - protein, 9 aa, Homo sapiens
ETFKDFYNC

SEQ ID NO: 7475 - protein, 9 aa, Homo sapiens
SPGSSPKVL

SEQ ID NO: 7476 - protein, 9 aa, Homo sapiens
RSAQQVVAV

SEQ ID NO: 7477 - protein, 9 aa, Homo sapiens
RMIRSAQQV

SEQ ID NO: 7478 - protein, 9 aa, Homo sapiens
RSAQQVVAV

SEQ ID NO: 7479 - protein, 9 aa, Homo sapiens
KMSIYQAMW

SEQ ID NO: 7480 - protein, 9 aa, Homo sapiens
YDYVRRRLT

SEQ ID NO: 7481 - protein, 9 aa, Homo sapiens
VHDAAREGF

SEQ ID NO: 7482 - protein, 9 aa, Homo sapiens
KHPSVNENF

SEQ ID NO: 7483 - protein, 9 aa, Homo sapiens
RVHECDHPV

SEQ ID NO: 7484 - protein, 9 aa, Homo sapiens
LSPDPTAAF

SEQ ID NO: 7485 - protein, 9 aa, Homo sapiens
YGRECANGY

SEQ ID NO: 7486 - protein, 9 aa, Homo sapiens
ESIHGPLNI

SEQ ID NO: 7487 - protein, 9 aa, Homo sapiens
LARPGRGGL

SEQ ID NO: 7488 - protein, 9 aa, Homo sapiens
DAAPIVSPL

SEQ ID NO: 7489 - protein, 9 aa, Homo sapiens
QFQRAPRGI

SEQ ID NO: 7490 - protein, 9 aa, Homo sapiens
LPDLPTATV

SEQ ID NO: 7491 - protein, 9 aa, Homo sapiens
VYHPTSERV

SEQ ID NO: 7492 - protein, 9 aa, Homo sapiens
QSLQRTYHL

SEQ ID NO: 7493 - protein, 9 aa, Homo sapiens
YHPERLQHY

SEQ ID NO: 7494 - protein, 9 aa, Homo sapiens
QHYINPEPM

SEQ ID NO: 7495 - protein, 9 aa, Homo sapiens
TCGSHLSVV

SEQ ID NO: 7496 - protein, 9 aa, Homo sapiens
STCGSHLSV

SEQ ID NO: 7497 - protein, 9 aa, Homo sapiens
STCGSHLSV

SEQ ID NO: 7498 - protein, 9 aa, Homo sapiens
LEMDSVLKV

SEQ ID NO: 7499 - protein, 9 aa, Homo sapiens
KALINADEL

SEQ ID NO: 7500 - protein, 9 aa, Homo sapiens
NADELASDV

SEQ ID NO: 7501 - protein, 9 aa, Homo sapiens
VWEHLYNRF

SEQ ID NO: 7502 - protein, 9 aa, Homo sapiens
NVWEHLYNR

SEQ ID NO: 7503 - protein, 9 aa, Homo sapiens
NVWEHLYNR

SEQ ID NO: 7504 - protein, 9 aa, Homo sapiens
NRFGGGPAV

SEQ ID NO: 7505 - protein, 9 aa, Homo sapiens
WLFAINVYF

SEQ ID NO: 7506 - protein, 9 aa, Homo sapiens
VYFNAFWTI

SEQ ID NO: 7507 - protein, 9 aa, Homo sapiens
VVWLFAINV

SEQ ID NO: 7508 - protein, 9 aa, Homo sapiens
WLFAINVYF

SEQ ID NO: 7509 - protein, 9 aa, Homo sapiens
AINVYFNAF

SEQ ID NO: 7510 - protein, 9 aa, Homo sapiens
VYFNAFWTI

SEQ ID NO: 7511 - protein, 9 aa, Homo sapiens
VYFNAFWTI

SEQ ID NO: 7512 - protein, 9 aa, Homo sapiens
TPLTPRPSI

SEQ ID NO: 7513 - protein, 9 aa, Homo sapiens
LTPRPSITY

SEQ ID NO: 7514 - protein, 9 aa, Homo sapiens
VFGVLLCNV

SEQ ID NO: 7515 - protein, 9 aa, Homo sapiens
LCNVVTVAF

SEQ ID NO: 7516 - protein, 9 aa, Homo sapiens
VLLCNVVTV

SEQ ID NO: 7517 - protein, 9 aa, Homo sapiens
RQHYALTIF

SEQ ID NO: 7518 - protein, 9 aa, Homo sapiens
YALTIFQSI

SEQ ID NO: 7519 - protein, 9 aa, Homo sapiens
RQHYALTIF

SEQ ID NO: 7520 - protein, 9 aa, Homo sapiens
YALTIFQSI

SEQ ID NO: 7521 - protein, 9 aa, Homo sapiens
MPKLGGRSG

SEQ ID NO: 7522 - protein, 9 aa, Homo sapiens
FVVRRTTEL

SEQ ID NO: 7523 - protein, 9 aa, Homo sapiens
LIFFPAYFL

SEQ ID NO: 7524 - protein, 9 aa, Homo sapiens
LIFFPAYFL

SEQ ID NO: 7525 - protein, 9 aa, Homo sapiens
FPAYFLNAV

SEQ ID NO: 7526 - protein, 9 aa, Homo sapiens
YEKRRLLIV

SEQ ID NO: 7527 - protein, 9 aa, Homo sapiens
TDRDLILKW

SEQ ID NO: 7528 - protein, 9 aa, Homo sapiens
FLEDDPEDI

SEQ ID NO: 7529 - protein, 9 aa, Homo sapiens
LINLGNTCF

SEQ ID NO: 7530 - protein, 9 aa, Homo sapiens
ITCAVINRV

SEQ ID NO: 7531 - protein, 9 aa, Homo sapiens
AVINRVQKV

SEQ ID NO: 7532 - protein, 9 aa, Homo sapiens
RHQRERQEL

SEQ ID NO: 7533 - protein, 9 aa, Homo sapiens
RFHSLIPSY

SEQ ID NO: 7534 - protein, 9 aa, Homo sapiens
FHSLIPSYI

SEQ ID NO: 7535 - protein, 9 aa, Homo sapiens
INLVAANRV

SEQ ID NO: 7536 - protein, 9 aa, Homo sapiens
ALAMANVGI

SEQ ID NO: 7537 - protein, 9 aa, Homo sapiens
FTRICRDPV

SEQ ID NO: 7538 - protein, 9 aa, Homo sapiens
VYKTGDVPL

SEQ ID NO: 7539 - protein, 9 aa, Homo sapiens
YKTGDVPLI

SEQ ID NO: 7540 - protein, 9 aa, Homo sapiens
RRNCMAATL

SEQ ID NO: 7541 - protein, 9 aa, Homo sapiens
IILNRRNCM

SEQ ID NO: 7542 - protein, 9 aa, Homo sapiens
NCMAATLKI

SEQ ID NO: 7543 - protein, 9 aa, Homo sapiens
LMGRDIDII

SEQ ID NO: 7544 - protein, 9 aa, Homo sapiens
SQLWVGYSL

SEQ ID NO: 7545 - protein, 9 aa, Homo sapiens
SQLWVGYSL

SEQ ID NO: 7546 - protein, 9 aa, Homo sapiens
YLQHASWAV

SEQ ID NO: 7547 - protein, 9 aa, Homo sapiens
SWAVTVNGL

SEQ ID NO: 7548 - protein, 9 aa, Homo sapiens
YLQHASWAV

SEQ ID NO: 7549 - protein, 9 aa, Homo sapiens
QHASWAVTV

SEQ ID NO: 7550 - protein, 9 aa, Homo sapiens
WAVTVNGLI

SEQ ID NO: 7551 - protein, 9 aa, Homo sapiens
KSFKAHISV

SEQ ID NO: 7552 - protein, 9 aa, Homo sapiens
KQKSFKAHI

SEQ ID NO: 7553 - protein, 9 aa, Homo sapiens
KSFKAHISV

SEQ ID NO: 7554 - protein, 9 aa, Homo sapiens
LMVGPHAAV

SEQ ID NO: 7555 - protein, 9 aa, Homo sapiens
TYRSMAHYL

SEQ ID NO: 7556 - protein, 9 aa, Homo sapiens
RSMAHYLKV

SEQ ID NO: 7557 - protein, 9 aa, Homo sapiens
IYCIGFQEL

SEQ ID NO: 7558 - protein, 9 aa, Homo sapiens
KKMETMYPF

SEQ ID NO: 7559 - protein, 9 aa, Homo sapiens
IFWKTWIFW

SEQ ID NO: 7560 - protein, 9 aa, Homo sapiens
WIFWKTWIF

SEQ ID NO: 7561 - protein, 9 aa, Homo sapiens
WIFWKTWIF

SEQ ID NO: 7562 - protein, 9 aa, Homo sapiens
KTWIFWKTW

SEQ ID NO: 7563 - protein, 9 aa, Homo sapiens
WIFWKTWIF

SEQ ID NO: 7564 - protein, 9 aa, Homo sapiens
VSVENVLYV

SEQ ID NO: 7565 - protein, 9 aa, Homo sapiens
QHCKPEEGL

SEQ ID NO: 7566 - protein, 9 aa, Homo sapiens
RSHTGERPY

SEQ ID NO: 7567 - protein, 9 aa, Homo sapiens
KLTDIWEEL

SEQ ID NO: 7568 - protein, 9 aa, Homo sapiens
LTDIWEELK

SEQ ID NO: 7569 - protein, 9 aa, Homo sapiens
LERKLTDIW

SEQ ID NO: 7570 - protein, 9 aa, Homo sapiens
DSCTCFVNR

SEQ ID NO: 7571 - protein, 9 aa, Homo sapiens
FLHVLGDAL

SEQ ID NO: 7572 - protein, 9 aa, Homo sapiens
VLGDALGSV

SEQ ID NO: 7573 - protein, 9 aa, Homo sapiens
ALGSVIVVV

SEQ ID NO: 7574 - protein, 9 aa, Homo sapiens
YFLNVFFPL

SEQ ID NO: 7575 - protein, 9 aa, Homo sapiens
FLNVFFPLL

SEQ ID NO: 7576 - protein, 9 aa, Homo sapiens
VLQRYLQQL

SEQ ID NO: 7577 - protein, 9 aa, Homo sapiens
TGSDVQTPK

SEQ ID NO: 7578 - protein, 9 aa, Homo sapiens
VQTPKCHLK

SEQ ID NO: 7579 - protein, 9 aa, Homo sapiens
QTPKCHLKR

SEQ ID NO: 7580 - protein, 9 aa, Homo sapiens
RQTDVRVTK

SEQ ID NO: 7581 - protein, 9 aa, Homo sapiens
TLLSVSEYK

SEQ ID NO: 7582 - protein, 9 aa, Homo sapiens
FSLHEVSRV

SEQ ID NO: 7583 - protein, 9 aa, Homo sapiens
SLHEVSRVL

SEQ ID NO: 7584 - protein, 9 aa, Homo sapiens
ILHMALTGA

SEQ ID NO: 7585 - protein, 9 aa, Homo sapiens
VTTDCVHSF

SEQ ID NO: 7586 - protein, 9 aa, Homo sapiens
CLDFTMQEL

SEQ ID NO: 7587 - protein, 9 aa, Homo sapiens
LLVDGRLRL

SEQ ID NO: 7588 - protein, 9 aa, Homo sapiens
ISSSFGNEE

SEQ ID NO: 7589 - protein, 9 aa, Homo sapiens
YLRNFIHGG

SEQ ID NO: 7590 - protein, 9 aa, Homo sapiens
FVYVFTTHL

SEQ ID NO: 7591 - protein, 9 aa, Homo sapiens
SVSKLLLVI

SEQ ID NO: 7592 - protein, 9 aa, Homo sapiens
KMFACSKFV

SEQ ID NO: 7593 - protein, 9 aa, Homo sapiens
YLLRLALRS

SEQ ID NO: 7594 - protein, 9 aa, Homo sapiens
RLALRSPDV

SEQ ID NO: 7595 - protein, 9 aa, Homo sapiens
YLLFMIGYA

SEQ ID NO: 7596 - protein, 9 aa, Homo sapiens
FMIGYASAL

SEQ ID NO: 7597 - protein, 9 aa, Homo sapiens
MIGYASALV

SEQ ID NO: 7598 - protein, 9 aa, Homo sapiens
YASALVSLL

SEQ ID NO: 7599 - protein, 9 aa, Homo sapiens
SSVHRHPFL

SEQ ID NO: 7600 - protein, 9 aa, Homo sapiens
FIDQYYSSI

SEQ ID NO: 7601 - protein, 9 aa, Homo sapiens
DQYYSSIKR

SEQ ID NO: 7602 - protein, 9 aa, Homo sapiens
ALASRVDAA

SEQ ID NO: 7603 - protein, 9 aa, Homo sapiens
LLLPSMLMF

SEQ ID NO: 7604 - protein, 9 aa, Homo sapiens
LLPSMLMFA

SEQ ID NO: 7605 - protein, 9 aa, Homo sapiens
SMLMFAVIV

SEQ ID NO: 7606 - protein, 9 aa, Homo sapiens
MLMFAVIVA

SEQ ID NO: 7607 - protein, 9 aa, Homo sapiens
LMFAVIVAS

SEQ ID NO: 7608 - protein, 9 aa, Homo sapiens
VLREFQTYI

SEQ ID NO: 7609 - protein, 9 aa, Homo sapiens
TVLREFQTY

SEQ ID NO: 7610 - protein, 9 aa, Homo sapiens
QTYIRSMDK

SEQ ID NO: 7611 - protein, 9 aa, Homo sapiens
SSSPAAPAR

SEQ ID NO: 7612 - protein, 9 aa, Homo sapiens
ALATCVNVV

SEQ ID NO: 7613 - protein, 9 aa, Homo sapiens
ATIGSCVVR

SEQ ID NO: 7614 - protein, 9 aa, Homo sapiens
FLFMYLVTV

SEQ ID NO: 7615 - protein, 9 aa, Homo sapiens
YLVTVAGNL

SEQ ID NO: 7616 - protein, 9 aa, Homo sapiens
VTVAGNLLI

SEQ ID NO: 7617 - protein, 9 aa, Homo sapiens
TVAGNLLII

SEQ ID NO: 7618 - protein, 9 aa, Homo sapiens
VLLLNMLIA

SEQ ID NO: 7619 - protein, 9 aa, Homo sapiens
LLLNMLIAL

SEQ ID NO: 7620 - protein, 9 aa, Homo sapiens
LLNMLIALM

SEQ ID NO: 7621 - protein, 9 aa, Homo sapiens
RACGRFFQK

SEQ ID NO: 7622 - protein, 9 aa, Homo sapiens
TTNTSPQQG

SEQ ID NO: 7623 - protein, 9 aa, Homo sapiens
ASYRASEQK

SEQ ID NO: 7624 - protein, 9 aa, Homo sapiens
AAAAIQSQR

SEQ ID NO: 7625 - protein, 9 aa, Homo sapiens
SLRKEGLPV

SEQ ID NO: 7626 - protein, 9 aa, Homo sapiens
SVMLTSHSM

SEQ ID NO: 7627 - protein, 9 aa, Homo sapiens
KQSGDVELV

SEQ ID NO: 7628 - protein, 9 aa, Homo sapiens
GDVELVLAY

SEQ ID NO: 7629 - protein, 9 aa, Homo sapiens
VELVLAYAA

SEQ ID NO: 7630 - protein, 9 aa, Homo sapiens
FSMDRKVEK

SEQ ID NO: 7631 - protein, 9 aa, Homo sapiens
SILPMSHEI

SEQ ID NO: 7632 - protein, 9 aa, Homo sapiens
FSILPMSHE

SEQ ID NO: 7633 - protein, 9 aa, Homo sapiens
VATMRDLGK

SEQ ID NO: 7634 - protein, 9 aa, Homo sapiens
SIKSFPGGK

SEQ ID NO: 7635 - protein, 9 aa, Homo sapiens
GTGRGQPEK

SEQ ID NO: 7636 - protein, 9 aa, Homo sapiens
TLLIGSSLL

SEQ ID NO: 7637 - protein, 9 aa, Homo sapiens
LIAMYFYTM

SEQ ID NO: 7638 - protein, 9 aa, Homo sapiens
SLLARVAGR

SEQ ID NO: 7639 - protein, 9 aa, Homo sapiens
ATMVTNVVR

SEQ ID NO: 7640 - protein, 9 aa, Homo sapiens
ILAACLESA

SEQ ID NO: 7641 - protein, 9 aa, Homo sapiens
QLYDTLDIT

SEQ ID NO: 7642 - protein, 9 aa, Homo sapiens
ALDPDMIQA

SEQ ID NO: 7643 - protein, 9 aa, Homo sapiens
KISRCQVCV

SEQ ID NO: 7644 - protein, 9 aa, Homo sapiens
VQASGLLRL

SEQ ID NO: 7645 - protein, 9 aa, Homo sapiens
QVQASGLLR

SEQ ID NO: 7646 - protein, 9 aa, Homo sapiens
LTLAAVTPR

SEQ ID NO: 7647 - protein, 9 aa, Homo sapiens
RQRNPRYEK

SEQ ID NO: 7648 - protein, 9 aa, Homo sapiens
YVLTEIEYK

SEQ ID NO: 7649 - protein, 9 aa, Homo sapiens
KIEVVLPEK

SEQ ID NO: 7650 - protein, 9 aa, Homo sapiens
RSFQPLASR

SEQ ID NO: 7651 - protein, 9 aa, Homo sapiens
LLRVFKLAK

SEQ ID NO: 7652 - protein, 9 aa, Homo sapiens
GGAEGFHLH

SEQ ID NO: 7653 - protein, 9 aa, Homo sapiens
SLLCGRTPL

SEQ ID NO: 7654 - protein, 9 aa, Homo sapiens
RLAAAFEFL

SEQ ID NO: 7655 - protein, 9 aa, Homo sapiens
TLLKQVRVV

SEQ ID NO: 7656 - protein, 9 aa, Homo sapiens
HMAARAGQV

SEQ ID NO: 7657 - protein, 9 aa, Homo sapiens
LTRSVYSDR

SEQ ID NO: 7658 - protein, 9 aa, Homo sapiens
FMPNRLFFG

SEQ ID NO: 7659 - protein, 9 aa, Homo sapiens
TLIYQMAPA

SEQ ID NO: 7660 - protein, 9 aa, Homo sapiens
LIYQMAPAV

SEQ ID NO: 7661 - protein, 9 aa, Homo sapiens
YQMAPAVSK

SEQ ID NO: 7662 - protein, 9 aa, Homo sapiens
LIFNMFYWI

SEQ ID NO: 7663 - protein, 9 aa, Homo sapiens
MFYWIIYKI

SEQ ID NO: 7664 - protein, 9 aa, Homo sapiens
NMFYWIIYK

SEQ ID NO: 7665 - protein, 9 aa, Homo sapiens
KVANEPSLK

SEQ ID NO: 7666 - protein, 9 aa, Homo sapiens
ATLADVMPR

SEQ ID NO: 7667 - protein, 9 aa, Homo sapiens
TLADVMPRK

SEQ ID NO: 7668 - protein, 9 aa, Homo sapiens
AEATLADVM

SEQ ID NO: 7669 - protein, 9 aa, Homo sapiens
VTFEDVAVY

SEQ ID NO: 7670 - protein, 9 aa, Homo sapiens
TFEDVAVYF

SEQ ID NO: 7671 - protein, 9 aa, Homo sapiens
YLGETQFAP

SEQ ID NO: 7672 - protein, 9 aa, Homo sapiens
FAPGQWAGV

SEQ ID NO: 7673 - protein, 9 aa, Homo sapiens
KPLLHQDAK

SEQ ID NO: 7674 - protein, 9 aa, Homo sapiens
EELLCAVCY

SEQ ID NO: 7675 - protein, 9 aa, Homo sapiens
HLGERMRYA

SEQ ID NO: 7676 - protein, 9 aa, Homo sapiens
GERMRYAVY

SEQ ID NO: 7677 - protein, 9 aa, Homo sapiens
AIRTEYNLR

SEQ ID NO: 7678 - protein, 9 aa, Homo sapiens
QMYRRVYRL

SEQ ID NO: 7679 - protein, 9 aa, Homo sapiens
RLHERLVAI

SEQ ID NO: 7680 - protein, 9 aa, Homo sapiens
LLIDRGFSK

SEQ ID NO: 7681 - protein, 9 aa, Homo sapiens
KLQYAVSGL

SEQ ID NO: 7682 - protein, 9 aa, Homo sapiens
GQQGLFGQK

SEQ ID NO: 7683 - protein, 9 aa, Homo sapiens
QLDAGVRYL

SEQ ID NO: 7684 - protein, 9 aa, Homo sapiens
FRASGGKPI

SEQ ID NO: 7685 - protein, 9 aa, Homo sapiens
SAVGSTQLL

SEQ ID NO: 7686 - protein, 9 aa, Homo sapiens
WLFGHIQEL

SEQ ID NO: 7687 - protein, 9 aa, Homo sapiens
IAVGSFCLF

SEQ ID NO: 7688 - protein, 9 aa, Homo sapiens
VGSFCLFIF

SEQ ID NO: 7689 - protein, 9 aa, Homo sapiens
IYTDWKMEK

SEQ ID NO: 7690 - protein, 9 aa, Homo sapiens
GFEVGPVCF

SEQ ID NO: 7691 - protein, 9 aa, Homo sapiens
NRTTIQEFI

SEQ ID NO: 7692 - protein, 9 aa, Homo sapiens
PFPDDFPNF

SEQ ID NO: 7693 - protein, 9 aa, Homo sapiens
FPDDFPNFM

SEQ ID NO: 7694 - protein, 9 aa, Homo sapiens
FVPVFLNCW

SEQ ID NO: 7695 - protein, 9 aa, Homo sapiens
RRKCQTRRL

SEQ ID NO: 7696 - protein, 9 aa, Homo sapiens
LHATVMNTL

SEQ ID NO: 7697 - protein, 9 aa, Homo sapiens
YMNDDPGMV

SEQ ID NO: 7698 - protein, 9 aa, Homo sapiens
TVPKALAIF

SEQ ID NO: 7699 - protein, 9 aa, Homo sapiens
ARNCCETSI

SEQ ID NO: 7700 - protein, 9 aa, Homo sapiens
TVFPMDKMI

SEQ ID NO: 7701 - protein, 9 aa, Homo sapiens
IQLFTTHFF

SEQ ID NO: 7702 - protein, 9 aa, Homo sapiens
IQLFTTHFF

SEQ ID NO: 7703 - protein, 9 aa, Homo sapiens
FYATCIYTY

SEQ ID NO: 7704 - protein, 9 aa, Homo sapiens
FYATCIYTY

SEQ ID NO: 7705 - protein, 9 aa, Homo sapiens
SRRVCVCFI

SEQ ID NO: 7706 - protein, 9 aa, Homo sapiens
KFLPGSRLL

SEQ ID NO: 7707 - protein, 9 aa, Homo sapiens
KFLPGSRLL

SEQ ID NO: 7708 - protein, 9 aa, Homo sapiens
SFSWRQAAF

SEQ ID NO: 7709 - protein, 9 aa, Homo sapiens
ERNNRTRLA

SEQ ID NO: 7710 - protein, 9 aa, Homo sapiens
AYGCIYASL

SEQ ID NO: 7711 - protein, 9 aa, Homo sapiens
AYGCIYASL

SEQ ID NO: 7712 - protein, 9 aa, Homo sapiens
WLLNEFPVF

SEQ ID NO: 7713 - protein, 9 aa, Homo sapiens
RYVAICKPL

SEQ ID NO: 7714 - protein, 9 aa, Homo sapiens
RYVAICKPL

SEQ ID NO: 7715 - protein, 9 aa, Homo sapiens
QVLLWRTNF

SEQ ID NO: 7716 - protein, 9 aa, Homo sapiens
QYQKTKLTI

SEQ ID NO: 7717 - protein, 9 aa, Homo sapiens
QYQKTKLTI

SEQ ID NO: 7718 - protein, 9 aa, Homo sapiens
SFPRWRSYF

SEQ ID NO: 7719 - protein, 9 aa, Homo sapiens
PRWRSYFYF

SEQ ID NO: 7720 - protein, 9 aa, Homo sapiens
RWRSYFYFI

SEQ ID NO: 7721 - protein, 9 aa, Homo sapiens
RSYFYFITL

SEQ ID NO: 7722 - protein, 9 aa, Homo sapiens
SYFYFITLI

SEQ ID NO: 7723 - protein, 9 aa, Homo sapiens
SFPRWRSYF

SEQ ID NO: 7724 - protein, 9 aa, Homo sapiens
RWRSYFYFI

SEQ ID NO: 7725 - protein, 9 aa, Homo sapiens
RSYFYFITL

SEQ ID NO: 7726 - protein, 9 aa, Homo sapiens
SYFYFITLI

SEQ ID NO: 7727 - protein, 9 aa, Homo sapiens
SYFYFITLI

SEQ ID NO: 7728 - protein, 9 aa, Homo sapiens
YLQKQLKRF

SEQ ID NO: 7729 - protein, 9 aa, Homo sapiens
TCPACGRGF

SEQ ID NO: 7730 - protein, 9 aa, Homo sapiens
TCPACGRGF

SEQ ID NO: 7731 - protein, 9 aa, Homo sapiens
TYDYRSDIW

SEQ ID NO: 7732 - protein, 9 aa, Homo sapiens
DYRSDIWSL

SEQ ID NO: 7733 - protein, 9 aa, Homo sapiens
TYDYRSDIW

SEQ ID NO: 7734 - protein, 9 aa, Homo sapiens
DYRSDIWSL

SEQ ID NO: 7735 - protein, 9 aa, Homo sapiens
DYRSDIWSL

SEQ ID NO: 7736 - protein, 9 aa, Homo sapiens
SFQTVSALF

SEQ ID NO: 7737 - protein, 9 aa, Homo sapiens
SFQTVSALF

SEQ ID NO: 7738 - protein, 9 aa, Homo sapiens
LFRENLNKL

SEQ ID NO: 7739 - protein, 9 aa, Homo sapiens
YYDDTFPSM

SEQ ID NO: 7740 - protein, 9 aa, Homo sapiens
TFPSMKEQM

SEQ ID NO: 7741 - protein, 9 aa, Homo sapiens
TYVSCLKSL

SEQ ID NO: 7742 - protein, 9 aa, Homo sapiens
TYVSCLKSL

SEQ ID NO: 7743 - protein, 9 aa, Homo sapiens
TYVSCLKSL

SEQ ID NO: 7744 - protein, 9 aa, Homo sapiens
ADPNIAKLV

SEQ ID NO: 7745 - protein, 9 aa, Homo sapiens
MTARAWASW

SEQ ID NO: 7746 - protein, 9 aa, Homo sapiens
DHYYPVPYI

SEQ ID NO: 7747 - protein, 9 aa, Homo sapiens
FREMDDNQG

SEQ ID NO: 7748 - protein, 9 aa, Homo sapiens
PHARIIELL

SEQ ID NO: 7749 - protein, 9 aa, Homo sapiens
RRGRSPSDI

SEQ ID NO: 7750 - protein, 9 aa, Homo sapiens
LRKNPNFDI

SEQ ID NO: 7751 - protein, 9 aa, Homo sapiens
NPNFDICTL

SEQ ID NO: 7752 - protein, 9 aa, Homo sapiens
LDTARQEYL

SEQ ID NO: 7753 - protein, 9 aa, Homo sapiens
YRREREEAT

SEQ ID NO: 7754 - protein, 9 aa, Homo sapiens
EREEATYLL

SEQ ID NO: 7755 - protein, 9 aa, Homo sapiens
IHNFRANNV

SEQ ID NO: 7756 - protein, 9 aa, Homo sapiens
FRANNVSPM

SEQ ID NO: 7757 - protein, 9 aa, Homo sapiens
FRLSDSFSL

SEQ ID NO: 7758 - protein, 9 aa, Homo sapiens
LFLVAVHEL

SEQ ID NO: 7759 - protein, 9 aa, Homo sapiens
DRPQVVNAL

SEQ ID NO: 7760 - protein, 9 aa, Homo sapiens
LYHSNSPRW

SEQ ID NO: 7761 - protein, 9 aa, Homo sapiens
LYHSNSPRW

SEQ ID NO: 7762 - protein, 9 aa, Homo sapiens
VYQEVEEQK

SEQ ID NO: 7763 - protein, 9 aa, Homo sapiens
LYCAIKQQM

SEQ ID NO: 7764 - protein, 9 aa, Homo sapiens
LYCAIKQQM

SEQ ID NO: 7765 - protein, 9 aa, Homo sapiens
FRQSANLYV

SEQ ID NO: 7766 - protein, 9 aa, Homo sapiens
VRASVPQKL

SEQ ID NO: 7767 - protein, 9 aa, Homo sapiens
WLMRNSWNF

SEQ ID NO: 7768 - protein, 9 aa, Homo sapiens
MRNSWNFKF

SEQ ID NO: 7769 - protein, 9 aa, Homo sapiens
WLMRNSWNF

SEQ ID NO: 7770 - protein, 9 aa, Homo sapiens
TQSEREQEI

SEQ ID NO: 7771 - protein, 9 aa, Homo sapiens
DRGDGSLKY

SEQ ID NO: 7772 - protein, 9 aa, Homo sapiens
TANDNIPTI

SEQ ID NO: 7773 - protein, 9 aa, Homo sapiens
DVYEHQLIP

SEQ ID NO: 7774 - protein, 9 aa, Homo sapiens
EYKMYSMEV

SEQ ID NO: 7775 - protein, 9 aa, Homo sapiens
WRTIIPALL

SEQ ID NO: 7776 - protein, 9 aa, Homo sapiens
APLQSIQTL

SEQ ID NO: 7777 - protein, 9 aa, Homo sapiens
NEKEREEYV

SEQ ID NO: 7778 - protein, 9 aa, Homo sapiens
SRSNVTLPA

SEQ ID NO: 7779 - protein, 9 aa, Homo sapiens
DRITRAHAV

SEQ ID NO: 7780 - protein, 9 aa, Homo sapiens
VFIFRYLKV

SEQ ID NO: 7781 - protein, 9 aa, Homo sapiens
VFIFRYLKV

SEQ ID NO: 7782 - protein, 9 aa, Homo sapiens
FGTRFMSLI

SEQ ID NO: 7783 - protein, 9 aa, Homo sapiens
FVVAVLYCF

SEQ ID NO: 7784 - protein, 9 aa, Homo sapiens
LFGFGASIF

SEQ ID NO: 7785 - protein, 9 aa, Homo sapiens
LFGFGASIF

SEQ ID NO: 7786 - protein, 9 aa, Homo sapiens
NMYDNVNKL

SEQ ID NO: 7787 - protein, 9 aa, Homo sapiens
SYASTAPEL

SEQ ID NO: 7788 - protein, 9 aa, Homo sapiens
YHYPKAGSE

SEQ ID NO: 7789 - protein, 9 aa, Homo sapiens
FTYLTNSLF

SEQ ID NO: 7790 - protein, 9 aa, Homo sapiens
TWVPLSVIL

SEQ ID NO: 7791 - protein, 9 aa, Homo sapiens
SQYSVNPEL

SEQ ID NO: 7792 - protein, 9 aa, Homo sapiens
DIYAMGLVF

SEQ ID NO: 7793 - protein, 9 aa, Homo sapiens
FKRADIYAM

SEQ ID NO: 7794 - protein, 9 aa, Homo sapiens
FFGDEFLRL

SEQ ID NO: 7795 - protein, 9 aa, Homo sapiens
FGDEFLRLL

SEQ ID NO: 7796 - protein, 9 aa, Homo sapiens
GHFARDCPV

SEQ ID NO: 7797 - protein, 9 aa, Homo sapiens
SHVDLVKDL

SEQ ID NO: 7798 - protein, 9 aa, Homo sapiens
ALLWGCALA

SEQ ID NO: 7799 - protein, 9 aa, Homo sapiens
LLWGCALAA

SEQ ID NO: 7800 - protein, 9 aa, Homo sapiens
LWGCALAAA

SEQ ID NO: 7801 - protein, 9 aa, Homo sapiens
ARACFALLW

SEQ ID NO: 7802 - protein, 9 aa, Homo sapiens
ARACFALLW

SEQ ID NO: 7803 - protein, 9 aa, Homo sapiens
CRAAERLQV

SEQ ID NO: 7804 - protein, 9 aa, Homo sapiens
YPCAVGQTA

SEQ ID NO: 7805 - protein, 9 aa, Homo sapiens
HQFCVGAAK

SEQ ID NO: 7806 - protein, 9 aa, Homo sapiens
HQFCVGAAK

SEQ ID NO: 7807 - protein, 9 aa, Homo sapiens
NLSDSDFVM

SEQ ID NO: 7808 - protein, 9 aa, Homo sapiens
AHRDWYHRI

SEQ ID NO: 7809 - protein, 9 aa, Homo sapiens
YHRIDPTVL

SEQ ID NO: 7810 - protein, 9 aa, Homo sapiens
WVGPDDRLV

SEQ ID NO: 7811 - protein, 9 aa, Homo sapiens
RRGSMNNEL

SEQ ID NO: 7812 - protein, 9 aa, Homo sapiens
RRGSMNNEL

SEQ ID NO: 7813 - protein, 9 aa, Homo sapiens
FRRILNVTK

SEQ ID NO: 7814 - protein, 9 aa, Homo sapiens
RRILNVTKA

SEQ ID NO: 7815 - protein, 9 aa, Homo sapiens
MLSELSIIT

SEQ ID NO: 7816 - protein, 9 aa, Homo sapiens
ITFDGNNAA

SEQ ID NO: 7817 - protein, 9 aa, Homo sapiens
GMGPLLATV

SEQ ID NO: 7818 - protein, 9 aa, Homo sapiens
TVSGASTGV

SEQ ID NO: 7819 - protein, 9 aa, Homo sapiens
LREDQSSPV

SEQ ID NO: 7820 - protein, 9 aa, Homo sapiens
FVHPEPGHV

SEQ ID NO: 7821 - protein, 9 aa, Homo sapiens
VHPEPGHVL

SEQ ID NO: 7822 - protein, 9 aa, Homo sapiens
LQLTAYYVV

SEQ ID NO: 7823 - protein, 9 aa, Homo sapiens
YVVTWIVGA

SEQ ID NO: 7824 - protein, 9 aa, Homo sapiens
VVTWIVGAK

SEQ ID NO: 7825 - protein, 9 aa, Homo sapiens
WLLWVVAAT

SEQ ID NO: 7826 - protein, 9 aa, Homo sapiens
SLRNSPTSV

SEQ ID NO: 7827 - protein, 9 aa, Homo sapiens
HRLYSLRNS

SEQ ID NO: 7828 - protein, 9 aa, Homo sapiens
LRNSPTSVL

SEQ ID NO: 7829 - protein, 9 aa, Homo sapiens
YRILKAYTI

SEQ ID NO: 7830 - protein, 9 aa, Homo sapiens
LLAALTRPA

SEQ ID NO: 7831 - protein, 9 aa, Homo sapiens
RLLLAALTR

SEQ ID NO: 7832 - protein, 9 aa, Homo sapiens
FRWQWHEVE

SEQ ID NO: 7833 - protein, 9 aa, Homo sapiens
WHEVEAPYL

SEQ ID NO: 7834 - protein, 9 aa, Homo sapiens
GRGGLGPPA

SEQ ID NO: 7835 - protein, 9 aa, Homo sapiens
RMAPSLTFK

SEQ ID NO: 7836 - protein, 9 aa, Homo sapiens
GLVHVGDEL

SEQ ID NO: 7837 - protein, 9 aa, Homo sapiens
RSFVGLGPR

SEQ ID NO: 7838 - protein, 9 aa, Homo sapiens
VLQCIAGCV

SEQ ID NO: 7839 - protein, 9 aa, Homo sapiens
ERFDTALCV

SEQ ID NO: 7840 - protein, 9 aa, Homo sapiens
KRFCASTRL

SEQ ID NO: 7841 - protein, 9 aa, Homo sapiens
FQAARTLLP

SEQ ID NO: 7842 - protein, 9 aa, Homo sapiens
GLLSPPMAT

SEQ ID NO: 7843 - protein, 9 aa, Homo sapiens
YQFDKVGIL

SEQ ID NO: 7844 - protein, 9 aa, Homo sapiens
YQFDKVGIL

SEQ ID NO: 7845 - protein, 9 aa, Homo sapiens
MTPWLGLIV

SEQ ID NO: 7846 - protein, 9 aa, Homo sapiens
YSAKNTSEL

SEQ ID NO: 7847 - protein, 9 aa, Homo sapiens
SAKNTSELL

SEQ ID NO: 7848 - protein, 9 aa, Homo sapiens
KRTEQEETI

SEQ ID NO: 7849 - protein, 9 aa, Homo sapiens
GIFEVCWNA

SEQ ID NO: 7850 - protein, 9 aa, Homo sapiens
RRLCDLRLF

SEQ ID NO: 7851 - protein, 9 aa, Homo sapiens
EFFDETRRL

SEQ ID NO: 7852 - protein, 9 aa, Homo sapiens
TRRLCDLRL

SEQ ID NO: 7853 - protein, 9 aa, Homo sapiens
LLTGRNASL

SEQ ID NO: 7854 - protein, 9 aa, Homo sapiens
SRAASVGRY

SEQ ID NO: 7855 - protein, 9 aa, Homo sapiens
ARTKQTARK

SEQ ID NO: 7856 - protein, 9 aa, Homo sapiens
LVLLVHARA

SEQ ID NO: 7857 - protein, 9 aa, Homo sapiens
WLLALSPDL

SEQ ID NO: 7858 - protein, 9 aa, Homo sapiens
DLSLSNATV

SEQ ID NO: 7859 - protein, 9 aa, Homo sapiens
GRIADCRLL

SEQ ID NO: 7860 - protein, 9 aa, Homo sapiens
KLFCDIAGM

SEQ ID NO: 7861 - protein, 9 aa, Homo sapiens
CLAVKEWFV

SEQ ID NO: 7862 - protein, 9 aa, Homo sapiens
MSFDRYIAL

SEQ ID NO: 7863 - protein, 9 aa, Homo sapiens
MSFDRYIAL

SEQ ID NO: 7864 - protein, 9 aa, Homo sapiens
SISIVALFV

SEQ ID NO: 7865 - protein, 9 aa, Homo sapiens
HSISIVALF

SEQ ID NO: 7866 - protein, 9 aa, Homo sapiens
ISPKHRLIK

SEQ ID NO: 7867 - protein, 9 aa, Homo sapiens
VRYISPKHR

SEQ ID NO: 7868 - protein, 9 aa, Homo sapiens
YISPKHRLI

SEQ ID NO: 7869 - protein, 9 aa, Homo sapiens
GLLAGTLAG

SEQ ID NO: 7870 - protein, 9 aa, Homo sapiens
LLAGTLAGV

SEQ ID NO: 7871 - protein, 9 aa, Homo sapiens
MHQSLTQQR

SEQ ID NO: 7872 - protein, 9 aa, Homo sapiens
TRQPVVILL

SEQ ID NO: 7873 - protein, 9 aa, Homo sapiens
ETRQPVVIL

SEQ ID NO: 7874 - protein, 9 aa, Homo sapiens
RALPCTPAL

SEQ ID NO: 7875 - protein, 9 aa, Homo sapiens
RALPCTPAL

SEQ ID NO: 7876 - protein, 9 aa, Homo sapiens
KADVLDVVV

SEQ ID NO: 7877 - protein, 9 aa, Homo sapiens
RLHEEAQLL

SEQ ID NO: 7878 - protein, 9 aa, Homo sapiens
GASGGWRHL

SEQ ID NO: 7879 - protein, 9 aa, Homo sapiens
GASGGWRHL

SEQ ID NO: 7880 - protein, 9 aa, Homo sapiens
FAFLPVEDL

SEQ ID NO: 7881 - protein, 9 aa, Homo sapiens
FAFLPVEDL

SEQ ID NO: 7882 - protein, 9 aa, Homo sapiens
AAAAVAQEI

SEQ ID NO: 7883 - protein, 9 aa, Homo sapiens
AAVAQEIQM

SEQ ID NO: 7884 - protein, 9 aa, Homo sapiens
KSPPTAAAA

SEQ ID NO: 7885 - protein, 9 aa, Homo sapiens
ALLPAAMVM

SEQ ID NO: 7886 - protein, 9 aa, Homo sapiens
MVMPPQPVV

SEQ ID NO: 7887 - protein, 9 aa, Homo sapiens
YALLPAAMV

SEQ ID NO: 7888 - protein, 9 aa, Homo sapiens
ALLPAAMVM

SEQ ID NO: 7889 - protein, 9 aa, Homo sapiens
AMVMPPQPV

SEQ ID NO: 7890 - protein, 9 aa, Homo sapiens
MVMPPQPVV

SEQ ID NO: 7891 - protein, 9 aa, Homo sapiens
YALLPAAMV

SEQ ID NO: 7892 - protein, 9 aa, Homo sapiens
MVMPPQPVV

SEQ ID NO: 7893 - protein, 9 aa, Homo sapiens
GLFALLSTT

SEQ ID NO: 7894 - protein, 9 aa, Homo sapiens
FALLSTTGF

SEQ ID NO: 7895 - protein, 9 aa, Homo sapiens
FALLSTTGF

SEQ ID NO: 7896 - protein, 9 aa, Homo sapiens
GSLSAEVGL

SEQ ID NO: 7897 - protein, 9 aa, Homo sapiens
LSAEVGLEI

SEQ ID NO: 7898 - protein, 9 aa, Homo sapiens
LVVVGAGGV

SEQ ID NO: 7899 - protein, 9 aa, Homo sapiens
IVVHCVNEI

SEQ ID NO: 7900 - protein, 9 aa, Homo sapiens
IVVHCVNEI

SEQ ID NO: 7901 - protein, 9 aa, Homo sapiens
ELLARGCPL

SEQ ID NO: 7902 - protein, 9 aa, Homo sapiens
EIAQAYIGL

SEQ ID NO: 7903 - protein, 9 aa, Homo sapiens
EIAQAYIGL

SEQ ID NO: 7904 - protein, 9 aa, Homo sapiens
IGLKETNRL

SEQ ID NO: 7905 - protein, 9 aa, Homo sapiens
IGLKETNRL

SEQ ID NO: 7906 - protein, 9 aa, Homo sapiens
DTVSSTMDL

SEQ ID NO: 7907 - protein, 9 aa, Homo sapiens
AVDGVIFQL

SEQ ID NO: 7908 - protein, 9 aa, Homo sapiens
MAALLRRLL

SEQ ID NO: 7909 - protein, 9 aa, Homo sapiens
MAALLRRLL

SEQ ID NO: 7910 - protein, 9 aa, Homo sapiens
RLTAEQLSL

SEQ ID NO: 7911 - protein, 9 aa, Homo sapiens
EGVFAVARL

SEQ ID NO: 7912 - protein, 9 aa, Homo sapiens
FAVARLTAE

SEQ ID NO: 7913 - protein, 9 aa, Homo sapiens
VARLTAEQL

SEQ ID NO: 7914 - protein, 9 aa, Homo sapiens
LLLLTLLLP

SEQ ID NO: 7915 - protein, 9 aa, Homo sapiens
LLTLLLPGL

SEQ ID NO: 7916 - protein, 9 aa, Homo sapiens
HVRFYQHLV

SEQ ID NO: 7917 - protein, 9 aa, Homo sapiens
HVRFYQHLV

SEQ ID NO: 7918 - protein, 9 aa, Homo sapiens
EASDLLERL

SEQ ID NO: 7919 - protein, 9 aa, Homo sapiens
CPLPGTSAY

SEQ ID NO: 7920 - protein, 9 aa, Homo sapiens
KGYHHFVLM

SEQ ID NO: 7921 - protein, 9 aa, Homo sapiens
LALRRKKVL

SEQ ID NO: 7922 - protein, 9 aa, Homo sapiens
LALRRKKVL

SEQ ID NO: 7923 - protein, 9 aa, Homo sapiens
GRASCEAVL

SEQ ID NO: 7924 - protein, 9 aa, Homo sapiens
ASCEAVLTV

SEQ ID NO: 7925 - protein, 9 aa, Homo sapiens
TICALVFLA

SEQ ID NO: 7926 - protein, 9 aa, Homo sapiens
LVFLAALFL

SEQ ID NO: 7927 - protein, 9 aa, Homo sapiens
CTICALVFL

SEQ ID NO: 7928 - protein, 9 aa, Homo sapiens
CALVFLAAL

SEQ ID NO: 7929 - protein, 9 aa, Homo sapiens
LVFLAALFL

SEQ ID NO: 7930 - protein, 9 aa, Homo sapiens
CALVFLAAL

SEQ ID NO: 7931 - protein, 9 aa, Homo sapiens
LVFLAALFL

SEQ ID NO: 7932 - protein, 9 aa, Homo sapiens
STSGRLRPL

SEQ ID NO: 7933 - protein, 9 aa, Homo sapiens
TNFLFFGPL

SEQ ID NO: 7934 - protein, 9 aa, Homo sapiens
IQPEIRKAV

SEQ ID NO: 7935 - protein, 9 aa, Homo sapiens
GPQDWVGPL

SEQ ID NO: 7936 - protein, 9 aa, Homo sapiens
GVAYVSVRV

SEQ ID NO: 7937 - protein, 9 aa, Homo sapiens
VGVAYVSVR

SEQ ID NO: 7938 - protein, 9 aa, Homo sapiens
VAYVSVRVT

SEQ ID NO: 7939 - protein, 9 aa, Homo sapiens
VAYVSVRVT

SEQ ID NO: 7940 - protein, 9 aa, Homo sapiens
FEEPRVIDL

SEQ ID NO: 7941 - protein, 9 aa, Homo sapiens
AEFEEPRVI

SEQ ID NO: 7942 - protein, 9 aa, Homo sapiens
MFYNHYPYV

SEQ ID NO: 7943 - protein, 9 aa, Homo sapiens
DMFYNHYPY

SEQ ID NO: 7944 - protein, 9 aa, Homo sapiens
MFYNHYPYV

SEQ ID NO: 7945 - protein, 9 aa, Homo sapiens
QGFETLQQI

SEQ ID NO: 7946 - protein, 9 aa, Homo sapiens
DTHQEYARV

SEQ ID NO: 7947 - protein, 9 aa, Homo sapiens
DTHQEYARV

SEQ ID NO: 7948 - protein, 9 aa, Homo sapiens
PALICPPNL

SEQ ID NO: 7949 - protein, 9 aa, Homo sapiens
KKFENEIIL

SEQ ID NO: 7950 - protein, 9 aa, Homo sapiens
CVAKPTETI

SEQ ID NO: 7951 - protein, 9 aa, Homo sapiens
KAPRVPDIL

SEQ ID NO: 7952 - protein, 9 aa, Homo sapiens
RLLQVPSSA

SEQ ID NO: 7953 - protein, 9 aa, Homo sapiens
FAVAHEATT

SEQ ID NO: 7954 - protein, 9 aa, Homo sapiens
FAVAHEATT

SEQ ID NO: 7955 - protein, 9 aa, Homo sapiens
TARMNVAQL

SEQ ID NO: 7956 - protein, 9 aa, Homo sapiens
TARMNVAQL

SEQ ID NO: 7957 - protein, 9 aa, Homo sapiens
QLMSGRMPA

SEQ ID NO: 7958 - protein, 9 aa, Homo sapiens
LMSGRMPAA

SEQ ID NO: 7959 - protein, 9 aa, Homo sapiens
SQAQDGAVV

SEQ ID NO: 7960 - protein, 9 aa, Homo sapiens
AQDGAVVTA

SEQ ID NO: 7961 - protein, 9 aa, Homo sapiens
ASRQRTRVV

SEQ ID NO: 7962 - protein, 9 aa, Homo sapiens
RQRTRVVRR

SEQ ID NO: 7963 - protein, 9 aa, Homo sapiens
RTRVVRRSL

SEQ ID NO: 7964 - protein, 9 aa, Homo sapiens
VVRRSLSPV

SEQ ID NO: 7965 - protein, 9 aa, Homo sapiens
ASRQRTRVV

SEQ ID NO: 7966 - protein, 9 aa, Homo sapiens
TRVVRRSLS

SEQ ID NO: 7967 - protein, 9 aa, Homo sapiens
PLFDCPTWA

SEQ ID NO: 7968 - protein, 9 aa, Homo sapiens
FLIRESEST

SEQ ID NO: 7969 - protein, 9 aa, Homo sapiens
GSKSSDDQK

SEQ ID NO: 7970 - protein, 9 aa, Homo sapiens
LRWEQVVDL

SEQ ID NO: 7971 - protein, 9 aa, Homo sapiens
VQYELWAAL

SEQ ID NO: 7972 - protein, 9 aa, Homo sapiens
CHTNQRGEL

SEQ ID NO: 7973 - protein, 9 aa, Homo sapiens
MDRGFVFSL

SEQ ID NO: 7974 - protein, 9 aa, Homo sapiens
FLNDLLSVM

SEQ ID NO: 7975 - protein, 9 aa, Homo sapiens
KANWYFLLA

SEQ ID NO: 7976 - protein, 9 aa, Homo sapiens
KFKEMVYSL

SEQ ID NO: 7977 - protein, 9 aa, Homo sapiens
KEMVYSLFK

SEQ ID NO: 7978 - protein, 9 aa, Homo sapiens
MVYSLFKAK

SEQ ID NO: 7979 - protein, 9 aa, Homo sapiens
LLGQRIVRL

SEQ ID NO: 7980 - protein, 9 aa, Homo sapiens
GQRIVRLLV

SEQ ID NO: 7981 - protein, 9 aa, Homo sapiens
LLDRTVDRL

SEQ ID NO: 7982 - protein, 9 aa, Homo sapiens
AELEEQKRL

SEQ ID NO: 7983 - protein, 9 aa, Homo sapiens
QLADYQSFA

SEQ ID NO: 7984 - protein, 9 aa, Homo sapiens
LADYQSFAV

SEQ ID NO: 7985 - protein, 9 aa, Homo sapiens
TRDDGTQLA

SEQ ID NO: 7986 - protein, 9 aa, Homo sapiens
GIYDILLAL

SEQ ID NO: 7987 - protein, 9 aa, Homo sapiens
VHRRYSALR

SEQ ID NO: 7988 - protein, 9 aa, Homo sapiens
TTRQITGDR

SEQ ID NO: 7989 - protein, 9 aa, Homo sapiens
DRAVYENEL

SEQ ID NO: 7990 - protein, 9 aa, Homo sapiens
VIFYNCSCL

SEQ ID NO: 7991 - protein, 9 aa, Homo sapiens
IFYNCSCLV

SEQ ID NO: 7992 - protein, 9 aa, Homo sapiens
CLVLDLQRI

SEQ ID NO: 7993 - protein, 9 aa, Homo sapiens
MIISHLSLI

SEQ ID NO: 7994 - protein, 9 aa, Homo sapiens
HLSLIHILL

SEQ ID NO: 7995 - protein, 9 aa, Homo sapiens
SLIHILLLF

SEQ ID NO: 7996 - protein, 9 aa, Homo sapiens
ISHLSLIHI

SEQ ID NO: 7997 - protein, 9 aa, Homo sapiens
SHLSLIHIL

SEQ ID NO: 7998 - protein, 9 aa, Homo sapiens
VLNPFIYTL

SEQ ID NO: 7999 - protein, 9 aa, Homo sapiens
YMVLASPSV

SEQ ID NO: 8000 - protein, 9 aa, Homo sapiens
VLASPSVPL

SEQ ID NO: 8001 - protein, 9 aa, Homo sapiens
KLFEQILKA

SEQ ID NO: 8002 - protein, 9 aa, Homo sapiens
KLFEQILKA

SEQ ID NO: 8003 - protein, 9 aa, Homo sapiens
FEQILKAEY

SEQ ID NO: 8004 - protein, 9 aa, Homo sapiens
SPNSSDPDV

SEQ ID NO: 8005 - protein, 9 aa, Homo sapiens
EEIWDSFKV

SEQ ID NO: 8006 - protein, 9 aa, Homo sapiens
VLRAEQQIK

SEQ ID NO: 8007 - protein, 9 aa, Homo sapiens
AEQQIKDNL

SEQ ID NO: 8008 - protein, 9 aa, Homo sapiens
GARGALLLA

SEQ ID NO: 8009 - protein, 9 aa, Homo sapiens
ARSGARGAL

SEQ ID NO: 8010 - protein, 9 aa, Homo sapiens
KSRESRDKQ

SEQ ID NO: 8011 - protein, 9 aa, Homo sapiens
NRPKSRESR

SEQ ID NO: 8012 - protein, 9 aa, Homo sapiens
EEEQWSDDF

SEQ ID NO: 8013 - protein, 9 aa, Homo sapiens
DMCKKMFEV

SEQ ID NO: 8014 - protein, 9 aa, Homo sapiens
KAEDSWPSD

SEQ ID NO: 8015 - protein, 9 aa, Homo sapiens
KMFDLRTKI

SEQ ID NO: 8016 - protein, 9 aa, Homo sapiens
MAKMFDLRT

SEQ ID NO: 8017 - protein, 9 aa, Homo sapiens
RFRSTFDAL

SEQ ID NO: 8018 - protein, 9 aa, Homo sapiens
RSTFDALRK

SEQ ID NO: 8019 - protein, 9 aa, Homo sapiens
RVTHFRDML

SEQ ID NO: 8020 - protein, 9 aa, Homo sapiens
ERVTHFRDM

SEQ ID NO: 8021 - protein, 9 aa, Homo sapiens
GRYVSAQPL

SEQ ID NO: 8022 - protein, 9 aa, Homo sapiens
RYVSAQPLA

SEQ ID NO: 8023 - protein, 9 aa, Homo sapiens
ALVRIPLHK

SEQ ID NO: 8024 - protein, 9 aa, Homo sapiens
LARRQGGLA

SEQ ID NO: 8025 - protein, 9 aa, Homo sapiens
TLFTIVGTV

SEQ ID NO: 8026 - protein, 9 aa, Homo sapiens
FTIVGTVAL

SEQ ID NO: 8027 - protein, 9 aa, Homo sapiens
SLLFLTFLT

SEQ ID NO: 8028 - protein, 9 aa, Homo sapiens
TEIQSLLFL

SEQ ID NO: 8029 - protein, 9 aa, Homo sapiens
SLDGKAIKV

SEQ ID NO: 8030 - protein, 9 aa, Homo sapiens
KSLDGKAIK

SEQ ID NO: 8031 - protein, 9 aa, Homo sapiens
AIKVAQATK

SEQ ID NO: 8032 - protein, 9 aa, Homo sapiens
GPNEINHLF

SEQ ID NO: 8033 - protein, 9 aa, Homo sapiens
GMNAINLPL

SEQ ID NO: 8034 - protein, 9 aa, Homo sapiens
AMNELQHDL

SEQ ID NO: 8035 - protein, 9 aa, Homo sapiens
RSLLQRVRR

SEQ ID NO: 8036 - protein, 9 aa, Homo sapiens
SLKWRPPER

SEQ ID NO: 8037 - protein, 9 aa, Homo sapiens
KWKAFSTCG

SEQ ID NO: 8038 - protein, 9 aa, Homo sapiens
AVLPLGAWV

SEQ ID NO: 8039 - protein, 9 aa, Homo sapiens
RLWEPLRVV

SEQ ID NO: 8040 - protein, 9 aa, Homo sapiens
TLYVTLATL

SEQ ID NO: 8041 - protein, 9 aa, Homo sapiens
RGSCAHDEF

SEQ ID NO: 8042 - protein, 9 aa, Homo sapiens
KSKRQKKER

SEQ ID NO: 8043 - protein, 9 aa, Homo sapiens
RQKKERMLL

SEQ ID NO: 8044 - protein, 9 aa, Homo sapiens
KRQKKERML

SEQ ID NO: 8045 - protein, 9 aa, Homo sapiens
PEACGGRAY

SEQ ID NO: 8046 - protein, 9 aa, Homo sapiens
RIHVRPSRA

SEQ ID NO: 8047 - protein, 9 aa, Homo sapiens
HVRPSRANT

SEQ ID NO: 8048 - protein, 9 aa, Homo sapiens
VRPSRANTL

SEQ ID NO: 8049 - protein, 9 aa, Homo sapiens
HQRTHTGEK

SEQ ID NO: 8050 - protein, 9 aa, Homo sapiens
RTHTGEKPY

SEQ ID NO: 8051 - protein, 9 aa, Homo sapiens
THTGEKPYV

SEQ ID NO: 8052 - protein, 9 aa, Homo sapiens
RTGSETPQA

SEQ ID NO: 8053 - protein, 9 aa, Homo sapiens
GSETPQAPM

SEQ ID NO: 8054 - protein, 9 aa, Homo sapiens
AIKKTRAQA

SEQ ID NO: 8055 - protein, 9 aa, Homo sapiens
ILHHAEPRV

SEQ ID NO: 8056 - protein, 9 aa, Homo sapiens
ALEPEKPLV

SEQ ID NO: 8057 - protein, 9 aa, Homo sapiens
GMALCPRQA

SEQ ID NO: 8058 - protein, 9 aa, Homo sapiens
QERKRALEA

SEQ ID NO: 8059 - protein, 9 aa, Homo sapiens
CVISVLYHV

SEQ ID NO: 8060 - protein, 9 aa, Homo sapiens
YHVGLMQWV

SEQ ID NO: 8061 - protein, 9 aa, Homo sapiens
HLFSKFYPC

SEQ ID NO: 8062 - protein, 9 aa, Homo sapiens
AQFIHLFSK

SEQ ID NO: 8063 - protein, 9 aa, Homo sapiens
AGRNSASPK

SEQ ID NO: 8064 - protein, 9 aa, Homo sapiens
RVRFAPSPT

SEQ ID NO: 8065 - protein, 9 aa, Homo sapiens
MLGVLELLL

SEQ ID NO: 8066 - protein, 9 aa, Homo sapiens
ASYYHCPEA

SEQ ID NO: 8067 - protein, 9 aa, Homo sapiens
EEIASYYHC

SEQ ID NO: 8068 - protein, 9 aa, Homo sapiens
RRRRRRPGG

SEQ ID NO: 8069 - protein, 9 aa, Homo sapiens
SLGSGTASL

SEQ ID NO: 8070 - protein, 9 aa, Homo sapiens
KQAHEVVSV

SEQ ID NO: 8071 - protein, 9 aa, Homo sapiens
RMAAISNTV

SEQ ID NO: 8072 - protein, 9 aa, Homo sapiens
ALSYTPVEV

SEQ ID NO: 8073 - protein, 9 aa, Homo sapiens
SELEHLTFV

SEQ ID NO: 8074 - protein, 9 aa, Homo sapiens
AGRRVTWNV

SEQ ID NO: 8075 - protein, 9 aa, Homo sapiens
LTRGDLSSI

SEQ ID NO: 8076 - protein, 9 aa, Homo sapiens
HLYSRIPGL

SEQ ID NO: 8077 - protein, 9 aa, Homo sapiens
GLLSPHPLL

SEQ ID NO: 8078 - protein, 9 aa, Homo sapiens
FLTVFSPFM

SEQ ID NO: 8079 - protein, 9 aa, Homo sapiens
SPFMMGALM

SEQ ID NO: 8080 - protein, 9 aa, Homo sapiens
RAFTTKGNL

SEQ ID NO: 8081 - protein, 9 aa, Homo sapiens
MLRAALLKV

SEQ ID NO: 8082 - protein, 9 aa, Homo sapiens
MLRAALLKV

SEQ ID NO: 8083 - protein, 9 aa, Homo sapiens
RTKGIYRVN

SEQ ID NO: 8084 - protein, 9 aa, Homo sapiens
QHRTRLRQI

SEQ ID NO: 8085 - protein, 9 aa, Homo sapiens
ELLEAQDRV

SEQ ID NO: 8086 - protein, 9 aa, Homo sapiens
ITLSWSPPR

SEQ ID NO: 8087 - protein, 9 aa, Homo sapiens
SETSITLSW

SEQ ID NO: 8088 - protein, 9 aa, Homo sapiens
RTSSSSSFS

SEQ ID NO: 8089 - protein, 9 aa, Homo sapiens
FIEARLEKL

SEQ ID NO: 8090 - protein, 9 aa, Homo sapiens
ILAAAKYKL

SEQ ID NO: 8091 - protein, 9 aa, Homo sapiens
KILAAAKYK

SEQ ID NO: 8092 - protein, 9 aa, Homo sapiens
KSSPPPFIA

SEQ ID NO: 8093 - protein, 9 aa, Homo sapiens
RLLRQSPLD

SEQ ID NO: 8094 - protein, 9 aa, Homo sapiens
LTSEDEDYV

SEQ ID NO: 8095 - protein, 9 aa, Homo sapiens
FLRIPSLHL

SEQ ID NO: 8096 - protein, 9 aa, Homo sapiens
SLHLLLFTS

SEQ ID NO: 8097 - protein, 9 aa, Homo sapiens
GSFLRIPSL

SEQ ID NO: 8098 - protein, 9 aa, Homo sapiens
LRIPSLHLL

SEQ ID NO: 8099 - protein, 9 aa, Homo sapiens
SFRLSGGGR

SEQ ID NO: 8100 - protein, 9 aa, Homo sapiens
RLSGGGRPA

SEQ ID NO: 8101 - protein, 9 aa, Homo sapiens
GVRFPGPGG

SEQ ID NO: 8102 - protein, 9 aa, Homo sapiens
LLSESNERL

SEQ ID NO: 8103 - protein, 9 aa, Homo sapiens
SESNERLQL

SEQ ID NO: 8104 - protein, 9 aa, Homo sapiens
RVPYVIISA

SEQ ID NO: 8105 - protein, 9 aa, Homo sapiens
LMLWASSSI

SEQ ID NO: 8106 - protein, 9 aa, Homo sapiens
KVFNRKRNL

SEQ ID NO: 8107 - protein, 9 aa, Homo sapiens
GLRHPNCKL

SEQ ID NO: 8108 - protein, 9 aa, Homo sapiens
FVPGMAAFA

SEQ ID NO: 8109 - protein, 9 aa, Homo sapiens
GASRRRFGK

SEQ ID NO: 8110 - protein, 9 aa, Homo sapiens
SRRRFGKPK

SEQ ID NO: 8111 - protein, 9 aa, Homo sapiens
RRRFGKPKA

SEQ ID NO: 8112 - protein, 9 aa, Homo sapiens
YSCRHGYEL

SEQ ID NO: 8113 - protein, 9 aa, Homo sapiens
YSCRHGYEL

SEQ ID NO: 8114 - protein, 9 aa, Homo sapiens
EPPSWVTEM

SEQ ID NO: 8115 - protein, 9 aa, Homo sapiens
YLWPAVQLA

SEQ ID NO: 8116 - protein, 9 aa, Homo sapiens
KAYGSHCYA

SEQ ID NO: 8117 - protein, 9 aa, Homo sapiens
GSHCYALFL

SEQ ID NO: 8118 - protein, 9 aa, Homo sapiens
LHRQLQEYL

SEQ ID NO: 8119 - protein, 9 aa, Homo sapiens
EFRCKNRHC

SEQ ID NO: 8120 - protein, 9 aa, Homo sapiens
YTYMMTHAA

SEQ ID NO: 8121 - protein, 9 aa, Homo sapiens
YVLTPLPWK

SEQ ID NO: 8122 - protein, 9 aa, Homo sapiens
VHASSPTAL

SEQ ID NO: 8123 - protein, 9 aa, Homo sapiens
RVRKPVNVQ

SEQ ID NO: 8124 - protein, 9 aa, Homo sapiens
VRKPVNVQM

SEQ ID NO: 8125 - protein, 9 aa, Homo sapiens
RGFLVKRSK

SEQ ID NO: 8126 - protein, 9 aa, Homo sapiens
ATVVFTTHV

SEQ ID NO: 8127 - protein, 9 aa, Homo sapiens
ATVVFTTHV

SEQ ID NO: 8128 - protein, 9 aa, Homo sapiens
LREPQATVV

SEQ ID NO: 8129 - protein, 9 aa, Homo sapiens
GLCDRCMVT

SEQ ID NO: 8130 - protein, 9 aa, Homo sapiens
RLRAGLCDR

SEQ ID NO: 8131 - protein, 9 aa, Homo sapiens
QVWFKASRV

SEQ ID NO: 8132 - protein, 9 aa, Homo sapiens
KASRVYTLV

SEQ ID NO: 8133 - protein, 9 aa, Homo sapiens
KASRVYTLV

SEQ ID NO: 8134 - protein, 9 aa, Homo sapiens
ASRVYTLVL

SEQ ID NO: 8135 - protein, 9 aa, Homo sapiens
FKASRVYTL

SEQ ID NO: 8136 - protein, 9 aa, Homo sapiens
GEVAFGLYM

SEQ ID NO: 8137 - protein, 9 aa, Homo sapiens
SSRGGCSIK

SEQ ID NO: 8138 - protein, 9 aa, Homo sapiens
KMTPSNIAI

SEQ ID NO: 8139 - protein, 9 aa, Homo sapiens
MTPSNIAIV

SEQ ID NO: 8140 - protein, 9 aa, Homo sapiens
KMTPSNIAI

SEQ ID NO: 8141 - protein, 9 aa, Homo sapiens
QQRSAQEIV

SEQ ID NO: 8142 - protein, 9 aa, Homo sapiens
RTKAGSKSA

SEQ ID NO: 8143 - protein, 9 aa, Homo sapiens
KAGSKSASR

SEQ ID NO: 8144 - protein, 9 aa, Homo sapiens
GSKSASRTH

SEQ ID NO: 8145 - protein, 9 aa, Homo sapiens
LTRLASHMA

SEQ ID NO: 8146 - protein, 9 aa, Homo sapiens
VTRLTFPLP

SEQ ID NO: 8147 - protein, 9 aa, Homo sapiens
PLPCVVLYA

SEQ ID NO: 8148 - protein, 9 aa, Homo sapiens
LMVLHSPSL

SEQ ID NO: 8149 - protein, 9 aa, Homo sapiens
ALRKNISKI

SEQ ID NO: 8150 - protein, 9 aa, Homo sapiens
RVASTNPAV

SEQ ID NO: 8151 - protein, 9 aa, Homo sapiens
RVASTNPAV

SEQ ID NO: 8152 - protein, 9 aa, Homo sapiens
GMYDSSLAA

SEQ ID NO: 8153 - protein, 9 aa, Homo sapiens
AGRRRPPSG

SEQ ID NO: 8154 - protein, 9 aa, Homo sapiens
KAIAKQLGI

SEQ ID NO: 8155 - protein, 9 aa, Homo sapiens
LLAHYLLGL

SEQ ID NO: 8156 - protein, 9 aa, Homo sapiens
SSMYTVTRM

SEQ ID NO: 8157 - protein, 9 aa, Homo sapiens
VTRMESMTV

SEQ ID NO: 8158 - protein, 9 aa, Homo sapiens
TRMESMTVV

SEQ ID NO: 8159 - protein, 9 aa, Homo sapiens
DRSEVLHQV

SEQ ID NO: 8160 - protein, 9 aa, Homo sapiens
KTSASSRVE

SEQ ID NO: 8161 - protein, 9 aa, Homo sapiens
SSRVETHQS

SEQ ID NO: 8162 - protein, 9 aa, Homo sapiens
MARCPYSPQ

SEQ ID NO: 8163 - protein, 9 aa, Homo sapiens
SSNDASPPA

SEQ ID NO: 8164 - protein, 9 aa, Homo sapiens
SIADSLSSL

SEQ ID NO: 8165 - protein, 9 aa, Homo sapiens
QTRRAMTLK

SEQ ID NO: 8166 - protein, 9 aa, Homo sapiens
NRNLSNEEL

SEQ ID NO: 8167 - protein, 9 aa, Homo sapiens
FMRCQLSRL

SEQ ID NO: 8168 - protein, 9 aa, Homo sapiens
RCQLSRLQK

SEQ ID NO: 8169 - protein, 9 aa, Homo sapiens
GLQAIAELL

SEQ ID NO: 8170 - protein, 9 aa, Homo sapiens
EENSRPHTN

SEQ ID NO: 8171 - protein, 9 aa, Homo sapiens
ASRGPTAAR

SEQ ID NO: 8172 - protein, 9 aa, Homo sapiens
FKRAFVRIL

SEQ ID NO: 8173 - protein, 9 aa, Homo sapiens
KVKATTAFQ

SEQ ID NO: 8174 - protein, 9 aa, Homo sapiens
KATTAFQFL

SEQ ID NO: 8175 - protein, 9 aa, Homo sapiens
AQWLGPLLL

SEQ ID NO: 8176 - protein, 9 aa, Homo sapiens
LLLVSLWGL

SEQ ID NO: 8177 - protein, 9 aa, Homo sapiens
SSRCQVDLI

SEQ ID NO: 8178 - protein, 9 aa, Homo sapiens
SAIGVTAAE

SEQ ID NO: 8179 - protein, 9 aa, Homo sapiens
GGRGGLGLV

SEQ ID NO: 8180 - protein, 9 aa, Homo sapiens
SAFGYFITA

SEQ ID NO: 8181 - protein, 9 aa, Homo sapiens
SAFGYFITA

SEQ ID NO: 8182 - protein, 9 aa, Homo sapiens
SESAFGYFI

SEQ ID NO: 8183 - protein, 9 aa, Homo sapiens
KTHRISVVD

SEQ ID NO: 8184 - protein, 9 aa, Homo sapiens
KLSEYRNSL

SEQ ID NO: 8185 - protein, 9 aa, Homo sapiens
YRNSLESKL

SEQ ID NO: 8186 - protein, 9 aa, Homo sapiens
AHSELPFAA

SEQ ID NO: 8187 - protein, 9 aa, Homo sapiens
FRQGSETPM

SEQ ID NO: 8188 - protein, 9 aa, Homo sapiens
GSLALRLLL

SEQ ID NO: 8189 - protein, 9 aa, Homo sapiens
KLNLWIHEM

SEQ ID NO: 8190 - protein, 9 aa, Homo sapiens
SVGNAHRQI

SEQ ID NO: 8191 - protein, 9 aa, Homo sapiens
VGNAHRQIP

SEQ ID NO: 8192 - protein, 9 aa, Homo sapiens
QRCELLARL

SEQ ID NO: 8193 - protein, 9 aa, Homo sapiens
SLRSRKSPS

SEQ ID NO: 8194 - protein, 9 aa, Homo sapiens
RSRKSPSPA

SEQ ID NO: 8195 - protein, 9 aa, Homo sapiens
FMLSLCLVP

SEQ ID NO: 8196 - protein, 9 aa, Homo sapiens
MLSLCLVPT

SEQ ID NO: 8197 - protein, 9 aa, Homo sapiens
SLCLVPTFA

SEQ ID NO: 8198 - protein, 9 aa, Homo sapiens
VPTFAVSCL

SEQ ID NO: 8199 - protein, 9 aa, Homo sapiens
PTFAVSCLL

SEQ ID NO: 8200 - protein, 9 aa, Homo sapiens
PTFAVSCLL

SEQ ID NO: 8201 - protein, 9 aa, Homo sapiens
QRIYDGQYL

SEQ ID NO: 8202 - protein, 9 aa, Homo sapiens
REELAQFHR

SEQ ID NO: 8203 - protein, 9 aa, Homo sapiens
EELAQFHRD

SEQ ID NO: 8204 - protein, 9 aa, Homo sapiens
FHRDGALTQ

SEQ ID NO: 8205 - protein, 9 aa, Homo sapiens
WYRDFMQLI

SEQ ID NO: 8206 - protein, 9 aa, Homo sapiens
KFRYDRPFH

SEQ ID NO: 8207 - protein, 9 aa, Homo sapiens
VYFGNPYPF

SEQ ID NO: 8208 - protein, 9 aa, Homo sapiens
KAQEGPPLA

SEQ ID NO: 8209 - protein, 9 aa, Homo sapiens
ATGNSILGS

SEQ ID NO: 8210 - protein, 9 aa, Homo sapiens
TGNSILGSL

SEQ ID NO: 8211 - protein, 9 aa, Homo sapiens
AVRTVRGNS

SEQ ID NO: 8212 - protein, 9 aa, Homo sapiens
VRTVRGNSF

SEQ ID NO: 8213 - protein, 9 aa, Homo sapiens
TVRRWNYPS

SEQ ID NO: 8214 - protein, 9 aa, Homo sapiens
RRWNYPSPL

SEQ ID NO: 8215 - protein, 9 aa, Homo sapiens
LVPRVKEVK

SEQ ID NO: 8216 - protein, 9 aa, Homo sapiens
HPRATFLGL

SEQ ID NO: 8217 - protein, 9 aa, Homo sapiens
LHHPRATFL

SEQ ID NO: 8218 - protein, 9 aa, Homo sapiens
WIYWDSNRL

SEQ ID NO: 8219 - protein, 9 aa, Homo sapiens
KLAPHYFHS

SEQ ID NO: 8220 - protein, 9 aa, Homo sapiens
YFHSISYKI

SEQ ID NO: 8221 - protein, 9 aa, Homo sapiens
HYFHSISYK

SEQ ID NO: 8222 - protein, 9 aa, Homo sapiens
RSRVSASHG

SEQ ID NO: 8223 - protein, 9 aa, Homo sapiens
RVSASHGPR

SEQ ID NO: 8224 - protein, 9 aa, Homo sapiens
VSASHGPRK

SEQ ID NO: 8225 - protein, 9 aa, Homo sapiens
VQRGPRPGA

SEQ ID NO: 8226 - protein, 9 aa, Homo sapiens
RLAEVEAAL

SEQ ID NO: 8227 - protein, 9 aa, Homo sapiens
MASRGRSFK

SEQ ID NO: 8228 - protein, 9 aa, Homo sapiens
ASRGRSFKQ

SEQ ID NO: 8229 - protein, 9 aa, Homo sapiens
RSFKQTSLA

SEQ ID NO: 8230 - protein, 9 aa, Homo sapiens
MPRPGKSSY

SEQ ID NO: 8231 - protein, 9 aa, Homo sapiens
FTFDFVFGK

SEQ ID NO: 8232 - protein, 9 aa, Homo sapiens
FTFDFVFGK

SEQ ID NO: 8233 - protein, 9 aa, Homo sapiens
RRCDRDSRC

SEQ ID NO: 8234 - protein, 9 aa, Homo sapiens
REKPGPEMA

SEQ ID NO: 8235 - protein, 9 aa, Homo sapiens
VREKPGPEM

SEQ ID NO: 8236 - protein, 9 aa, Homo sapiens
GSRPCRQRC

SEQ ID NO: 8237 - protein, 9 aa, Homo sapiens
RQRCPFRVR

SEQ ID NO: 8238 - protein, 9 aa, Homo sapiens
RCPFRVRFA

SEQ ID NO: 8239 - protein, 9 aa, Homo sapiens
QRCPFRVRF

SEQ ID NO: 8240 - protein, 9 aa, Homo sapiens
VRTDKKPAL

SEQ ID NO: 8241 - protein, 9 aa, Homo sapiens
FQWRKEISV

SEQ ID NO: 8242 - protein, 9 aa, Homo sapiens
YLGLLLAAT

SEQ ID NO: 8243 - protein, 9 aa, Homo sapiens
IHVSLVPQL

SEQ ID NO: 8244 - protein, 9 aa, Homo sapiens
RSVPATPVL

SEQ ID NO: 8245 - protein, 9 aa, Homo sapiens
CRYGDLASL

SEQ ID NO: 8246 - protein, 9 aa, Homo sapiens
KRRRNRPEA

SEQ ID NO: 8247 - protein, 9 aa, Homo sapiens
RRRNRPEAF

SEQ ID NO: 8248 - protein, 9 aa, Homo sapiens
RALFYLFSA

SEQ ID NO: 8249 - protein, 9 aa, Homo sapiens
RALFYLFSA

SEQ ID NO: 8250 - protein, 9 aa, Homo sapiens
TIWPNAPAV

SEQ ID NO: 8251 - protein, 9 aa, Homo sapiens
SSHTRPFSA

SEQ ID NO: 8252 - protein, 9 aa, Homo sapiens
HTRPFSAIA

SEQ ID NO: 8253 - protein, 9 aa, Homo sapiens
FIGFLGDEL

SEQ ID NO: 8254 - protein, 9 aa, Homo sapiens
SLDENECRV

SEQ ID NO: 8255 - protein, 9 aa, Homo sapiens
RVMKGNPSA

SEQ ID NO: 8256 - protein, 9 aa, Homo sapiens
RVMKGNPSA

SEQ ID NO: 8257 - protein, 9 aa, Homo sapiens
VENEFKAEY

SEQ ID NO: 8258 - protein, 9 aa, Homo sapiens
NVIEIDDTL

SEQ ID NO: 8259 - protein, 9 aa, Homo sapiens
LRLQEQAAL

SEQ ID NO: 8260 - protein, 9 aa, Homo sapiens
VVIGNIGAL

SEQ ID NO: 8261 - protein, 9 aa, Homo sapiens
RPLYNHPAG

SEQ ID NO: 8262 - protein, 9 aa, Homo sapiens
YFSTRMSRI

SEQ ID NO: 8263 - protein, 9 aa, Homo sapiens
DYEAGEISF

SEQ ID NO: 8264 - protein, 9 aa, Homo sapiens
RVHTGERPY

SEQ ID NO: 8265 - protein, 9 aa, Homo sapiens
GYRRYFTQI

SEQ ID NO: 8266 - protein, 9 aa, Homo sapiens
RYFTQIVGF

SEQ ID NO: 8267 - protein, 9 aa, Homo sapiens
RYFTQIVGF

SEQ ID NO: 8268 - protein, 9 aa, Homo sapiens
GYNKTLLRL

SEQ ID NO: 8269 - protein, 9 aa, Homo sapiens
YPREDTRAP

SEQ ID NO: 8270 - protein, 9 aa, Homo sapiens
HRETNLRYL

SEQ ID NO: 8271 - protein, 9 aa, Homo sapiens
LHTPMYFFI

SEQ ID NO: 8272 - protein, 9 aa, Homo sapiens
HLHTPMYFF

SEQ ID NO: 8273 - protein, 9 aa, Homo sapiens
APEEKGRVA

SEQ ID NO: 8274 - protein, 9 aa, Homo sapiens
RRVPPHVLV

SEQ ID NO: 8275 - protein, 9 aa, Homo sapiens
RVKGPLPVL

SEQ ID NO: 8276 - protein, 9 aa, Homo sapiens
YYVPPVCIY

SEQ ID NO: 8277 - protein, 9 aa, Homo sapiens
HFNSSIKQL

SEQ ID NO: 8278 - protein, 9 aa, Homo sapiens
VYPGHRPGL

SEQ ID NO: 8279 - protein, 9 aa, Homo sapiens
AVQTDGSPL

SEQ ID NO: 8280 - protein, 9 aa, Homo sapiens
APTIPVRRR

SEQ ID NO: 8281 - protein, 9 aa, Homo sapiens
IPVRRRLAW

SEQ ID NO: 8282 - protein, 9 aa, Homo sapiens
EDAIATFNV

SEQ ID NO: 8283 - protein, 9 aa, Homo sapiens
GRLTELRTF

SEQ ID NO: 8284 - protein, 9 aa, Homo sapiens
LFIIGSYTL

SEQ ID NO: 8285 - protein, 9 aa, Homo sapiens
RFPAEMQKH

SEQ ID NO: 8286 - protein, 9 aa, Homo sapiens
DARRSSHML

SEQ ID NO: 8287 - protein, 9 aa, Homo sapiens
ALGACGLLL

SEQ ID NO: 8288 - protein, 9 aa, Homo sapiens
IYREFERLI

SEQ ID NO: 8289 - protein, 9 aa, Homo sapiens
SMTPDAKHL

SEQ ID NO: 8290 - protein, 9 aa, Homo sapiens
QYFIGVLDI

SEQ ID NO: 8291 - protein, 9 aa, Homo sapiens
QPRQYFIGV

SEQ ID NO: 8292 - protein, 9 aa, Homo sapiens
RPASVCSSG

SEQ ID NO: 8293 - protein, 9 aa, Homo sapiens
YLQNQTFCF

SEQ ID NO: 8294 - protein, 9 aa, Homo sapiens
GPDVYVLPL

SEQ ID NO: 8295 - protein, 9 aa, Homo sapiens
LFSDTVLPL

SEQ ID NO: 8296 - protein, 9 aa, Homo sapiens
RPHTREKPF

SEQ ID NO: 8297 - protein, 9 aa, Homo sapiens
SPHNPNAPM

SEQ ID NO: 8298 - protein, 9 aa, Homo sapiens
EYDPSKATF

SEQ ID NO: 8299 - protein, 9 aa, Homo sapiens
QPRPPPRPT

SEQ ID NO: 8300 - protein, 9 aa, Homo sapiens
PPPRPTTSL

SEQ ID NO: 8301 - protein, 9 aa, Homo sapiens
APALWWGVV

SEQ ID NO: 8302 - protein, 9 aa, Homo sapiens
SKSSHWRIL

SEQ ID NO: 8303 - protein, 9 aa, Homo sapiens
RPSLSVQPV

SEQ ID NO: 8304 - protein, 9 aa, Homo sapiens
AAVKLGLRA

SEQ ID NO: 8305 - protein, 9 aa, Homo sapiens
YRHRSAHTS

SEQ ID NO: 8306 - protein, 9 aa, Homo sapiens
TPPAPAPAA

SEQ ID NO: 8307 - protein, 9 aa, Homo sapiens
NPRSSSRIA

SEQ ID NO: 8308 - protein, 9 aa, Homo sapiens
VPIGSMDVV

SEQ ID NO: 8309 - protein, 9 aa, Homo sapiens
PPMRRWSSV

SEQ ID NO: 8310 - protein, 9 aa, Homo sapiens
PPVPPPPPL

SEQ ID NO: 8311 - protein, 9 aa, Homo sapiens
VYSKAVNRL

SEQ ID NO: 8312 - protein, 9 aa, Homo sapiens
VYSKAVNRL

SEQ ID NO: 8313 - protein, 9 aa, Homo sapiens
RRLKRGAKP

SEQ ID NO: 8314 - protein, 9 aa, Homo sapiens
RPVRPVVQH

SEQ ID NO: 8315 - protein, 9 aa, Homo sapiens
SGYEGRVPL

SEQ ID NO: 8316 - protein, 9 aa, Homo sapiens
RDAGSPQAL

SEQ ID NO: 8317 - protein, 9 aa, Homo sapiens
GWLSYILPF

SEQ ID NO: 8318 - protein, 9 aa, Homo sapiens
GWLSYILPF

SEQ ID NO: 8319 - protein, 9 aa, Homo sapiens
YHVLYSCSY

SEQ ID NO: 8320 - protein, 9 aa, Homo sapiens
APLSSYISI

SEQ ID NO: 8321 - protein, 9 aa, Homo sapiens
VSHACYPLF

SEQ ID NO: 8322 - protein, 9 aa, Homo sapiens
MPGHNGEAG

SEQ ID NO: 8323 - protein, 9 aa, Homo sapiens
ALARKFITL

SEQ ID NO: 8324 - protein, 9 aa, Homo sapiens
LYTLCKELL

SEQ ID NO: 8325 - protein, 9 aa, Homo sapiens
LYTLCKELL

SEQ ID NO: 8326 - protein, 9 aa, Homo sapiens
LYTLCKELL

SEQ ID NO: 8327 - protein, 9 aa, Homo sapiens
LYTLCKELL

SEQ ID NO: 8328 - protein, 9 aa, Homo sapiens
IYGTHSHKL

SEQ ID NO: 8329 - protein, 9 aa, Homo sapiens
IYGTHSHKL

SEQ ID NO: 8330 - protein, 9 aa, Homo sapiens
TPVDSNSPV

SEQ ID NO: 8331 - protein, 9 aa, Homo sapiens
SMRAAMFLI

SEQ ID NO: 8332 - protein, 9 aa, Homo sapiens
MRAAMFLIF

SEQ ID NO: 8333 - protein, 9 aa, Homo sapiens
KPNAMGLAP

SEQ ID NO: 8334 - protein, 9 aa, Homo sapiens
KPGVKRTVT

SEQ ID NO: 8335 - protein, 9 aa, Homo sapiens
SPFTAVLLL

SEQ ID NO: 8336 - protein, 9 aa, Homo sapiens
HSSPFTAVL

SEQ ID NO: 8337 - protein, 9 aa, Homo sapiens
GPTQQSSLL

SEQ ID NO: 8338 - protein, 9 aa, Homo sapiens
HAHKWHRDL

SEQ ID NO: 8339 - protein, 9 aa, Homo sapiens
WHRDLCLLL

SEQ ID NO: 8340 - protein, 9 aa, Homo sapiens
KFGAVNRVI

SEQ ID NO: 8341 - protein, 9 aa, Homo sapiens
ELRKIQARM

SEQ ID NO: 8342 - protein, 9 aa, Homo sapiens
ARLSAAAVL

SEQ ID NO: 8343 - protein, 9 aa, Homo sapiens
NLRAAGGVL

SEQ ID NO: 8344 - protein, 9 aa, Homo sapiens
RAAGGVLPV

SEQ ID NO: 8345 - protein, 9 aa, Homo sapiens
RYVAICNPL

SEQ ID NO: 8346 - protein, 9 aa, Homo sapiens
SRTGPLCPA

SEQ ID NO: 8347 - protein, 9 aa, Homo sapiens
NWVTTPTTF

SEQ ID NO: 8348 - protein, 9 aa, Homo sapiens
GPQPAEGPQ

SEQ ID NO: 8349 - protein, 9 aa, Homo sapiens
YCFECHLPG

SEQ ID NO: 8350 - protein, 9 aa, Homo sapiens
NSFRGTIRK

SEQ ID NO: 8351 - protein, 9 aa, Homo sapiens
AQTNRHILR

SEQ ID NO: 8352 - protein, 9 aa, Homo sapiens
RLADGAEAA

SEQ ID NO: 8353 - protein, 9 aa, Homo sapiens
YRHIWSLEI

SEQ ID NO: 8354 - protein, 9 aa, Homo sapiens
SPVNVSSAV

SEQ ID NO: 8355 - protein, 9 aa, Homo sapiens
RVDHNGALL

SEQ ID NO: 8356 - protein, 9 aa, Homo sapiens
TRVDHNGAL

SEQ ID NO: 8357 - protein, 9 aa, Homo sapiens
LMIRRLRGV

SEQ ID NO: 8358 - protein, 9 aa, Homo sapiens
YSLMIRRLR

SEQ ID NO: 8359 - protein, 9 aa, Homo sapiens
IRRLRGVRL

SEQ ID NO: 8360 - protein, 9 aa, Homo sapiens
VTLALQRQR

SEQ ID NO: 8361 - protein, 9 aa, Homo sapiens
ILALVGEEV

SEQ ID NO: 8362 - protein, 9 aa, Homo sapiens
YMLTLRTKL

SEQ ID NO: 8363 - protein, 9 aa, Homo sapiens
RILKETEFK

SEQ ID NO: 8364 - protein, 9 aa, Homo sapiens
VLGSGAFGT

SEQ ID NO: 8365 - protein, 9 aa, Homo sapiens
AQYREAMEA

SEQ ID NO: 8366 - protein, 9 aa, Homo sapiens
YREAMEADL

SEQ ID NO: 8367 - protein, 9 aa, Homo sapiens
SSDRHLIPV

SEQ ID NO: 8368 - protein, 9 aa, Homo sapiens
ASGNFRHEY

SEQ ID NO: 8369 - protein, 9 aa, Homo sapiens
MVLNATESF

SEQ ID NO: 8370 - protein, 9 aa, Homo sapiens
SPSPILAVL

SEQ ID NO: 8371 - protein, 9 aa, Homo sapiens
QALRGPVHL

SEQ ID NO: 8372 - protein, 9 aa, Homo sapiens
QALRGPVHL

SEQ ID NO: 8373 - protein, 9 aa, Homo sapiens
SSHVAVVSL

SEQ ID NO: 8374 - protein, 9 aa, Homo sapiens
STAELRLNN

SEQ ID NO: 8375 - protein, 9 aa, Homo sapiens
LNNNEISIL

SEQ ID NO: 8376 - protein, 9 aa, Homo sapiens
FVLIHHCAK

SEQ ID NO: 8377 - protein, 9 aa, Homo sapiens
FCVTLGLFV

SEQ ID NO: 8378 - protein, 9 aa, Homo sapiens
VTLGLFVLI

SEQ ID NO: 8379 - protein, 9 aa, Homo sapiens
DPDLHCSSI

SEQ ID NO: 8380 - protein, 9 aa, Homo sapiens
WYFLSGATV

SEQ ID NO: 8381 - protein, 9 aa, Homo sapiens
FLSGATVTL

SEQ ID NO: 8382 - protein, 9 aa, Homo sapiens
NMLNLAVHL

SEQ ID NO: 8383 - protein, 9 aa, Homo sapiens
LSFSGNPLH

SEQ ID NO: 8384 - protein, 9 aa, Homo sapiens
FPTIHERPV

SEQ ID NO: 8385 - protein, 9 aa, Homo sapiens
SQNQDDVVL

SEQ ID NO: 8386 - protein, 9 aa, Homo sapiens
NQDDVVLHV

SEQ ID NO: 8387 - protein, 9 aa, Homo sapiens
YPYRTTVDY

SEQ ID NO: 8388 - protein, 9 aa, Homo sapiens
TSMATSSQY

SEQ ID NO: 8389 - protein, 9 aa, Homo sapiens
FDHNLQLCV

SEQ ID NO: 8390 - protein, 9 aa, Homo sapiens
MSRSTPSLV

SEQ ID NO: 8391 - protein, 9 aa, Homo sapiens
TLSQMLSAI

SEQ ID NO: 8392 - protein, 9 aa, Homo sapiens
VSQRLQGLR

SEQ ID NO: 8393 - protein, 9 aa, Homo sapiens
SQRLQGLRK

SEQ ID NO: 8394 - protein, 9 aa, Homo sapiens
LPAVTVTPA

SEQ ID NO: 8395 - protein, 9 aa, Homo sapiens
DPYVKLHLL

SEQ ID NO: 8396 - protein, 9 aa, Homo sapiens
WGHPSSPPV

SEQ ID NO: 8397 - protein, 9 aa, Homo sapiens
KVTEKTHRV

SEQ ID NO: 8398 - protein, 9 aa, Homo sapiens
PASRHAGNL

SEQ ID NO: 8399 - protein, 9 aa, Homo sapiens
FPLGPQEEV

SEQ ID NO: 8400 - protein, 9 aa, Homo sapiens
AVCPTPGCR

SEQ ID NO: 8401 - protein, 9 aa, Homo sapiens
VTCKSGDFS

SEQ ID NO: 8402 - protein, 9 aa, Homo sapiens
EARVIRVSI

SEQ ID NO: 8403 - protein, 9 aa, Homo sapiens
RVLPSERYK

SEQ ID NO: 8404 - protein, 9 aa, Homo sapiens
STVDLLTSI

SEQ ID NO: 8405 - protein, 9 aa, Homo sapiens
LGYSGSKPD

SEQ ID NO: 8406 - protein, 9 aa, Homo sapiens
YSGSKPDVI

SEQ ID NO: 8407 - protein, 9 aa, Homo sapiens
GAALPPPLL

SEQ ID NO: 8408 - protein, 9 aa, Homo sapiens
RSLTPLINR

SEQ ID NO: 8409 - protein, 9 aa, Homo sapiens
IMRSLTPLI

SEQ ID NO: 8410 - protein, 9 aa, Homo sapiens
WSNQRWSRA

SEQ ID NO: 8411 - protein, 9 aa, Homo sapiens
YAYTKVTGP

SEQ ID NO: 8412 - protein, 9 aa, Homo sapiens
PHATLRLDL

SEQ ID NO: 8413 - protein, 9 aa, Homo sapiens
HPSLPDSSL

SEQ ID NO: 8414 - protein, 9 aa, Homo sapiens
FLCSGCRRP

SEQ ID NO: 8415 - protein, 9 aa, Homo sapiens
LVLNVWGKV

SEQ ID NO: 8416 - protein, 9 aa, Homo sapiens
KLIQPATLK

SEQ ID NO: 8417 - protein, 9 aa, Homo sapiens
YKLIQPATL

SEQ ID NO: 8418 - protein, 9 aa, Homo sapiens
QPATLKNTL

SEQ ID NO: 8419 - protein, 9 aa, Homo sapiens
RVNLASRPE

SEQ ID NO: 8420 - protein, 9 aa, Homo sapiens
RAALDLAII

SEQ ID NO: 8421 - protein, 9 aa, Homo sapiens
GFNVAQTMF

SEQ ID NO: 8422 - protein, 9 aa, Homo sapiens
HGFNVAQTM

SEQ ID NO: 8423 - protein, 9 aa, Homo sapiens
HTAYISELK

SEQ ID NO: 8424 - protein, 9 aa, Homo sapiens
RHTAYISEL

SEQ ID NO: 8425 - protein, 9 aa, Homo sapiens
YISELKAKL

SEQ ID NO: 8426 - protein, 9 aa, Homo sapiens
AVCEFLQHN

SEQ ID NO: 8427 - protein, 9 aa, Homo sapiens
QHNNLLSIL

SEQ ID NO: 8428 - protein, 9 aa, Homo sapiens
AVCEFLQHN

SEQ ID NO: 8429 - protein, 9 aa, Homo sapiens
LQHNNLLSI

SEQ ID NO: 8430 - protein, 9 aa, Homo sapiens
QHNNLLSIL

SEQ ID NO: 8431 - protein, 9 aa, Homo sapiens
STYMAATGL

SEQ ID NO: 8432 - protein, 9 aa, Homo sapiens
MAATGLSAV

SEQ ID NO: 8433 - protein, 9 aa, Homo sapiens
AHSESSSHK

SEQ ID NO: 8434 - protein, 9 aa, Homo sapiens
LADQLHQPV

SEQ ID NO: 8435 - protein, 9 aa, Homo sapiens
PASELLQDV

SEQ ID NO: 8436 - protein, 9 aa, Homo sapiens
KARQSILQK

SEQ ID NO: 8437 - protein, 9 aa, Homo sapiens
FIKARQSIL

SEQ ID NO: 8438 - protein, 9 aa, Homo sapiens
AALPPAAPL

SEQ ID NO: 8439 - protein, 9 aa, Homo sapiens
RFGNQTLNY

SEQ ID NO: 8440 - protein, 9 aa, Homo sapiens
YTCEERGKV

SEQ ID NO: 8441 - protein, 9 aa, Homo sapiens
DVKFNGAHI

SEQ ID NO: 8442 - protein, 9 aa, Homo sapiens
GAHIPGSPF

SEQ ID NO: 8443 - protein, 9 aa, Homo sapiens
YPPGSRTQL

SEQ ID NO: 8444 - protein, 9 aa, Homo sapiens
LQVPFTCTI

SEQ ID NO: 8445 - protein, 9 aa, Homo sapiens
IEAEPGHSI

SEQ ID NO: 8446 - protein, 9 aa, Homo sapiens
TSLSVLWVY

SEQ ID NO: 8447 - protein, 9 aa, Homo sapiens
LAGTSLSVL

SEQ ID NO: 8448 - protein, 9 aa, Homo sapiens
LALHWKLTK

SEQ ID NO: 8449 - protein, 9 aa, Homo sapiens
VVCDDNGSK

SEQ ID NO: 8450 - protein, 9 aa, Homo sapiens
YADRRGKQL

SEQ ID NO: 8451 - protein, 9 aa, Homo sapiens
RAERAEGHL

SEQ ID NO: 8452 - protein, 9 aa, Homo sapiens
KIIEHFKRY

SEQ ID NO: 8453 - protein, 9 aa, Homo sapiens
KIIEHFKRY

SEQ ID NO: 8454 - protein, 9 aa, Homo sapiens
KRYGRVESV

SEQ ID NO: 8455 - protein, 9 aa, Homo sapiens
HSPDNNIIY

SEQ ID NO: 8456 - protein, 9 aa, Homo sapiens
HSPDNNIIY

SEQ ID NO: 8457 - protein, 9 aa, Homo sapiens
SPDNNIIYF

SEQ ID NO: 8458 - protein, 9 aa, Homo sapiens
EHSPDNNII

SEQ ID NO: 8459 - protein, 9 aa, Homo sapiens
HSPDNNIIY

SEQ ID NO: 8460 - protein, 9 aa, Homo sapiens
SPDNNIIYF

SEQ ID NO: 8461 - protein, 9 aa, Homo sapiens
KAQEFIHQF

SEQ ID NO: 8462 - protein, 9 aa, Homo sapiens
KAQEFIHQF

SEQ ID NO: 8463 - protein, 9 aa, Homo sapiens
KAQEFIHQF

SEQ ID NO: 8464 - protein, 9 aa, Homo sapiens
KAQEFIHQF

SEQ ID NO: 8465 - protein, 9 aa, Homo sapiens
KAQEFIHQF

SEQ ID NO: 8466 - protein, 9 aa, Homo sapiens
TQATGDSAF

SEQ ID NO: 8467 - protein, 9 aa, Homo sapiens
DVHMVSDSD

SEQ ID NO: 8468 - protein, 9 aa, Homo sapiens
DVHMVSDSD

SEQ ID NO: 8469 - protein, 9 aa, Homo sapiens
KMLEAENAL

SEQ ID NO: 8470 - protein, 9 aa, Homo sapiens
KMLEAENAL

SEQ ID NO: 8471 - protein, 9 aa, Homo sapiens
LPEKLRPLY

SEQ ID NO: 8472 - protein, 9 aa, Homo sapiens
MLPEKLRPL

SEQ ID NO: 8473 - protein, 9 aa, Homo sapiens
RPPVERFTF

SEQ ID NO: 8474 - protein, 9 aa, Homo sapiens
QPLASSKEM

SEQ ID NO: 8475 - protein, 9 aa, Homo sapiens
VAYTYSTTV

SEQ ID NO: 8476 - protein, 9 aa, Homo sapiens
VAYTYSTTV

SEQ ID NO: 8477 - protein, 9 aa, Homo sapiens
VAYTYSTTV

SEQ ID NO: 8478 - protein, 9 aa, Homo sapiens
YSTTVSPAV

SEQ ID NO: 8479 - protein, 9 aa, Homo sapiens
NTIDEGYVY

SEQ ID NO: 8480 - protein, 9 aa, Homo sapiens
HVFPSNTID

SEQ ID NO: 8481 - protein, 9 aa, Homo sapiens
FPSNTIDEG

SEQ ID NO: 8482 - protein, 9 aa, Homo sapiens
NTIDEGYVY

SEQ ID NO: 8483 - protein, 9 aa, Homo sapiens
YTSQNVLTK

SEQ ID NO: 8484 - protein, 9 aa, Homo sapiens
SHAYHGGVL

SEQ ID NO: 8485 - protein, 9 aa, Homo sapiens
YRDPPYHNW

SEQ ID NO: 8486 - protein, 9 aa, Homo sapiens
ATWSGWLKM

SEQ ID NO: 8487 - protein, 9 aa, Homo sapiens
QIAICLDPY

SEQ ID NO: 8488 - protein, 9 aa, Homo sapiens
YSSRQIAIC

SEQ ID NO: 8489 - protein, 9 aa, Homo sapiens
LVINYHQRV

SEQ ID NO: 8490 - protein, 9 aa, Homo sapiens
DNFGRGGNF

SEQ ID NO: 8491 - protein, 9 aa, Homo sapiens
DAAGVNQLF

SEQ ID NO: 8492 - protein, 9 aa, Homo sapiens
DAAGVNQLF

SEQ ID NO: 8493 - protein, 9 aa, Homo sapiens
DAAGVNQLF

SEQ ID NO: 8494 - protein, 9 aa, Homo sapiens
FSENLIYTY

SEQ ID NO: 8495 - protein, 9 aa, Homo sapiens
FSENLIYTY

SEQ ID NO: 8496 - protein, 9 aa, Homo sapiens
SAFGQDRSL

SEQ ID NO: 8497 - protein, 9 aa, Homo sapiens
YALYCPDAL

SEQ ID NO: 8498 - protein, 9 aa, Homo sapiens
YCPDALTAF

SEQ ID NO: 8499 - protein, 9 aa, Homo sapiens
YALYCPDAL

SEQ ID NO: 8500 - protein, 9 aa, Homo sapiens
YCPDALTAF

SEQ ID NO: 8501 - protein, 9 aa, Homo sapiens
DALTAFPTV

SEQ ID NO: 8502 - protein, 9 aa, Homo sapiens
AAAANLNAV

SEQ ID NO: 8503 - protein, 9 aa, Homo sapiens
DIYFVQVVI

SEQ ID NO: 8504 - protein, 9 aa, Homo sapiens
IYFVQVVIV

SEQ ID NO: 8505 - protein, 9 aa, Homo sapiens
SPVPTAPTS

SEQ ID NO: 8506 - protein, 9 aa, Homo sapiens
FPGGAAAVA

SEQ ID NO: 8507 - protein, 9 aa, Homo sapiens
ESFPGGAAA

SEQ ID NO: 8508 - protein, 9 aa, Homo sapiens
SSLQEISMY

SEQ ID NO: 8509 - protein, 9 aa, Homo sapiens
MANSSLQEI

SEQ ID NO: 8510 - protein, 9 aa, Homo sapiens
SSLQEISMY

SEQ ID NO: 8511 - protein, 9 aa, Homo sapiens
FSLFGIDNM

SEQ ID NO: 8512 - protein, 9 aa, Homo sapiens
QMCAKMSSF

SEQ ID NO: 8513 - protein, 9 aa, Homo sapiens
FCSVISEPI

SEQ ID NO: 8514 - protein, 9 aa, Homo sapiens
VISEPISEV

SEQ ID NO: 8515 - protein, 9 aa, Homo sapiens
IFYRIVKCF

SEQ ID NO: 8516 - protein, 9 aa, Homo sapiens
LAHGEELRF

SEQ ID NO: 8517 - protein, 9 aa, Homo sapiens
EVLFCFEQF

SEQ ID NO: 8518 - protein, 9 aa, Homo sapiens
LQQGVSATV

SEQ ID NO: 8519 - protein, 9 aa, Homo sapiens
LPRMCTRSL

SEQ ID NO: 8520 - protein, 9 aa, Homo sapiens
GASEGLPRM

SEQ ID NO: 8521 - protein, 9 aa, Homo sapiens
KFNQVLDQF

SEQ ID NO: 8522 - protein, 9 aa, Homo sapiens
FAGDVHDRY

SEQ ID NO: 8523 - protein, 9 aa, Homo sapiens
FAGDVHDRY

SEQ ID NO: 8524 - protein, 9 aa, Homo sapiens
IVKQGYVKI

SEQ ID NO: 8525 - protein, 9 aa, Homo sapiens
NPLLHAVMV

SEQ ID NO: 8526 - protein, 9 aa, Homo sapiens
IAVLRGLAY

SEQ ID NO: 8527 - protein, 9 aa, Homo sapiens
IAVLRGLAY

SEQ ID NO: 8528 - protein, 9 aa, Homo sapiens
AVLRGLAYL

SEQ ID NO: 8529 - protein, 9 aa, Homo sapiens
LPLAPESRV

SEQ ID NO: 8530 - protein, 9 aa, Homo sapiens
KSVVILVPV

SEQ ID NO: 8531 - protein, 9 aa, Homo sapiens
WPPFEYMIL

SEQ ID NO: 8532 - protein, 9 aa, Homo sapiens
TEWPPFEYM

SEQ ID NO: 8533 - protein, 9 aa, Homo sapiens
FEYMILATI

SEQ ID NO: 8534 - protein, 9 aa, Homo sapiens
DNFALTQHM

SEQ ID NO: 8535 - protein, 9 aa, Homo sapiens
DHNECEKSF

SEQ ID NO: 8536 - protein, 9 aa, Homo sapiens
TTEKPTDAY

SEQ ID NO: 8537 - protein, 9 aa, Homo sapiens
HPRPFIHGF

SEQ ID NO: 8538 - protein, 9 aa, Homo sapiens
RPFIHGFSF

SEQ ID NO: 8539 - protein, 9 aa, Homo sapiens
YALDRISKQ

SEQ ID NO: 8540 - protein, 9 aa, Homo sapiens
HVREDFSGL

SEQ ID NO: 8541 - protein, 9 aa, Homo sapiens
VPPPPIPPI

SEQ ID NO: 8542 - protein, 9 aa, Homo sapiens
TPVSLPPPV

SEQ ID NO: 8543 - protein, 9 aa, Homo sapiens
AALATVGLY

SEQ ID NO: 8544 - protein, 9 aa, Homo sapiens
AALATVGLY

SEQ ID NO: 8545 - protein, 9 aa, Homo sapiens
KEINRLSIL

SEQ ID NO: 8546 - protein, 9 aa, Homo sapiens
RTQRRKSTI

SEQ ID NO: 8547 - protein, 9 aa, Homo sapiens
RTQRRKSTI

SEQ ID NO: 8548 - protein, 9 aa, Homo sapiens
VPMVVVIAV

SEQ ID NO: 8549 - protein, 9 aa, Homo sapiens
VVVIAVSVY

SEQ ID NO: 8550 - protein, 9 aa, Homo sapiens
MVVVIAVSV

SEQ ID NO: 8551 - protein, 9 aa, Homo sapiens
EVDEGNTAV

SEQ ID NO: 8552 - protein, 9 aa, Homo sapiens
APVCTATTY

SEQ ID NO: 8553 - protein, 9 aa, Homo sapiens
AAPGTVVAL

SEQ ID NO: 8554 - protein, 9 aa, Homo sapiens
LSKDDIRRM

SEQ ID NO: 8555 - protein, 9 aa, Homo sapiens
IIYKKIALT

SEQ ID NO: 8556 - protein, 9 aa, Homo sapiens
IALTSANKL

SEQ ID NO: 8557 - protein, 9 aa, Homo sapiens
LVVKPGATV

SEQ ID NO: 8558 - protein, 9 aa, Homo sapiens
FAFNLNSDT

SEQ ID NO: 8559 - protein, 9 aa, Homo sapiens
FNLNSDTDV

SEQ ID NO: 8560 - protein, 9 aa, Homo sapiens
EAPAEMGAL

SEQ ID NO: 8561 - protein, 9 aa, Homo sapiens
ELLQNFTCL

SEQ ID NO: 8562 - protein, 9 aa, Homo sapiens
FQRDKWELL

SEQ ID NO: 8563 - protein, 9 aa, Homo sapiens
FRLTPPSPV

SEQ ID NO: 8564 - protein, 9 aa, Homo sapiens
FSMHNEEPF

SEQ ID NO: 8565 - protein, 9 aa, Homo sapiens
FSMHNEEPF

SEQ ID NO: 8566 - protein, 9 aa, Homo sapiens
QAPQHPQPL

SEQ ID NO: 8567 - protein, 9 aa, Homo sapiens
NEDDAMELL

SEQ ID NO: 8568 - protein, 9 aa, Homo sapiens
VSYDQATSL

SEQ ID NO: 8569 - protein, 9 aa, Homo sapiens
VSYDQATSL

SEQ ID NO: 8570 - protein, 9 aa, Homo sapiens
QSTPILKML

SEQ ID NO: 8571 - protein, 9 aa, Homo sapiens
SGDSALPLY

SEQ ID NO: 8572 - protein, 9 aa, Homo sapiens
LSGDSALPL

SEQ ID NO: 8573 - protein, 9 aa, Homo sapiens
TALLARALV

SEQ ID NO: 8574 - protein, 9 aa, Homo sapiens
IVGGFTQMI

SEQ ID NO: 8575 - protein, 9 aa, Homo sapiens
MLPEGVEMY

SEQ ID NO: 8576 - protein, 9 aa, Homo sapiens
MLPEGVEMY

SEQ ID NO: 8577 - protein, 9 aa, Homo sapiens
EGVEMYRTV

SEQ ID NO: 8578 - protein, 9 aa, Homo sapiens
EPFSEIERY

SEQ ID NO: 8579 - protein, 9 aa, Homo sapiens
EPFSEIERY

SEQ ID NO: 8580 - protein, 9 aa, Homo sapiens
YPLIALKAL

SEQ ID NO: 8581 - protein, 9 aa, Homo sapiens
YPLIALKAL

SEQ ID NO: 8582 - protein, 9 aa, Homo sapiens
KALKKALLL

SEQ ID NO: 8583 - protein, 9 aa, Homo sapiens
HAAQETPLL

SEQ ID NO: 8584 - protein, 9 aa, Homo sapiens
HAAQETPLL

SEQ ID NO: 8585 - protein, 9 aa, Homo sapiens
FHLDREIRL

SEQ ID NO: 8586 - protein, 9 aa, Homo sapiens
VTRASVEER

SEQ ID NO: 8587 - protein, 9 aa, Homo sapiens
YRFVTRASV

SEQ ID NO: 8588 - protein, 9 aa, Homo sapiens
LALDVAANR

SEQ ID NO: 8589 - protein, 9 aa, Homo sapiens
QGDDQLELI

SEQ ID NO: 8590 - protein, 9 aa, Homo sapiens
KALKDLKGR

SEQ ID NO: 8591 - protein, 9 aa, Homo sapiens
GKSASRFGR

SEQ ID NO: 8592 - protein, 9 aa, Homo sapiens
KSASRFGRR

SEQ ID NO: 8593 - protein, 9 aa, Homo sapiens
SHSNSPTAL

SEQ ID NO: 8594 - protein, 9 aa, Homo sapiens
IRFPWMLNM

SEQ ID NO: 8595 - protein, 9 aa, Homo sapiens
LLEKGFNPR

SEQ ID NO: 8596 - protein, 9 aa, Homo sapiens
ILRHPAQLL

SEQ ID NO: 8597 - protein, 9 aa, Homo sapiens
LSRALRYYY

SEQ ID NO: 8598 - protein, 9 aa, Homo sapiens
RALRYYYNK

SEQ ID NO: 8599 - protein, 9 aa, Homo sapiens
ALRYYYNKR

SEQ ID NO: 8600 - protein, 9 aa, Homo sapiens
LSRALRYYY

SEQ ID NO: 8601 - protein, 9 aa, Homo sapiens
LRYYYNKRI

SEQ ID NO: 8602 - protein, 9 aa, Homo sapiens
AAGPPVSTR

SEQ ID NO: 8603 - protein, 9 aa, Homo sapiens
KTSATLTVK

SEQ ID NO: 8604 - protein, 9 aa, Homo sapiens
AHQDRVEQI

SEQ ID NO: 8605 - protein, 9 aa, Homo sapiens
SFYIPRHVK

SEQ ID NO: 8606 - protein, 9 aa, Homo sapiens
FYIPRHVKK

SEQ ID NO: 8607 - protein, 9 aa, Homo sapiens
MRRGTWRIV

SEQ ID NO: 8608 - protein, 9 aa, Homo sapiens
RRGTWRIVV

SEQ ID NO: 8609 - protein, 9 aa, Homo sapiens
TSHEQGKFI

SEQ ID NO: 8610 - protein, 9 aa, Homo sapiens
QSRTGTPER

SEQ ID NO: 8611 - protein, 9 aa, Homo sapiens
HFRKAKSIR

SEQ ID NO: 8612 - protein, 9 aa, Homo sapiens
YHFRKAKSI

SEQ ID NO: 8613 - protein, 9 aa, Homo sapiens
FTTNDSYRF

SEQ ID NO: 8614 - protein, 9 aa, Homo sapiens
DSYRFSASR

SEQ ID NO: 8615 - protein, 9 aa, Homo sapiens
SYRFSASRR

SEQ ID NO: 8616 - protein, 9 aa, Homo sapiens
FLNGCNPVL

SEQ ID NO: 8617 - protein, 9 aa, Homo sapiens
RRSHSDASV

SEQ ID NO: 8618 - protein, 9 aa, Homo sapiens
YLIAMIGNS

SEQ ID NO: 8619 - protein, 9 aa, Homo sapiens
IYFFVGSFR

SEQ ID NO: 8620 - protein, 9 aa, Homo sapiens
FFVGSFRQR

SEQ ID NO: 8621 - protein, 9 aa, Homo sapiens
GSFRQRQNR

SEQ ID NO: 8622 - protein, 9 aa, Homo sapiens
ASQGPVSVW

SEQ ID NO: 8623 - protein, 9 aa, Homo sapiens
YHCECRSGF

SEQ ID NO: 8624 - protein, 9 aa, Homo sapiens
TRKNYTSLT

SEQ ID NO: 8625 - protein, 9 aa, Homo sapiens
HTPMYFFLR

SEQ ID NO: 8626 - protein, 9 aa, Homo sapiens
MYFFLRHLS

SEQ ID NO: 8627 - protein, 9 aa, Homo sapiens
LRHLSITDL

SEQ ID NO: 8628 - protein, 9 aa, Homo sapiens
HVFRGLGSL

SEQ ID NO: 8629 - protein, 9 aa, Homo sapiens
LRNKSVLDI

SEQ ID NO: 8630 - protein, 9 aa, Homo sapiens
SHLGRRPTL

SEQ ID NO: 8631 - protein, 9 aa, Homo sapiens
LAGVHALLR

SEQ ID NO: 8632 - protein, 9 aa, Homo sapiens
CEHQFCYPR

SEQ ID NO: 8633 - protein, 9 aa, Homo sapiens
AMADLESLR

SEQ ID NO: 8634 - protein, 9 aa, Homo sapiens
VAAAVSYLR

SEQ ID NO: 8635 - protein, 9 aa, Homo sapiens
AIRGLFSGR

SEQ ID NO: 8636 - protein, 9 aa, Homo sapiens
VIVAVNWTG

SEQ ID NO: 8637 - protein, 9 aa, Homo sapiens
RTRYSPIPP

SEQ ID NO: 8638 - protein, 9 aa, Homo sapiens
PPSHHQLTL

SEQ ID NO: 8639 - protein, 9 aa, Homo sapiens
YTAVAMPML

SEQ ID NO: 8640 - protein, 9 aa, Homo sapiens
TAVAMPMLY

SEQ ID NO: 8641 - protein, 9 aa, Homo sapiens
AMPMLYNTR

SEQ ID NO: 8642 - protein, 9 aa, Homo sapiens
TAVAMPMLY

SEQ ID NO: 8643 - protein, 9 aa, Homo sapiens
MPMLYNTRY

SEQ ID NO: 8644 - protein, 9 aa, Homo sapiens
TVDVYFGPR

SEQ ID NO: 8645 - protein, 9 aa, Homo sapiens
LSRTVDVYF

SEQ ID NO: 8646 - protein, 9 aa, Homo sapiens
RNGQKRSRR

SEQ ID NO: 8647 - protein, 9 aa, Homo sapiens
KRSRRRGTR

SEQ ID NO: 8648 - protein, 9 aa, Homo sapiens
FMYVKPSAK

SEQ ID NO: 8649 - protein, 9 aa, Homo sapiens
KYLLLGRWR

SEQ ID NO: 8650 - protein, 9 aa, Homo sapiens
GVQSHVWVR

SEQ ID NO: 8651 - protein, 9 aa, Homo sapiens
TATDPHCGW

SEQ ID NO: 8652 - protein, 9 aa, Homo sapiens
PYYPAYVPR

SEQ ID NO: 8653 - protein, 9 aa, Homo sapiens
TTAPPREER

SEQ ID NO: 8654 - protein, 9 aa, Homo sapiens
VPVIAMETF

SEQ ID NO: 8655 - protein, 9 aa, Homo sapiens
ETLAAFTGY

SEQ ID NO: 8656 - protein, 9 aa, Homo sapiens
VGLQSVYEK

SEQ ID NO: 8657 - protein, 9 aa, Homo sapiens
SVYEKVLHR

SEQ ID NO: 8658 - protein, 9 aa, Homo sapiens
KVLHRDYDR

SEQ ID NO: 8659 - protein, 9 aa, Homo sapiens
FHLKPDTPV

SEQ ID NO: 8660 - protein, 9 aa, Homo sapiens
CETPVNFFR

SEQ ID NO: 8661 - protein, 9 aa, Homo sapiens
AGILLIVLR

SEQ ID NO: 8662 - protein, 9 aa, Homo sapiens
MLYRNYLRS

SEQ ID NO: 8663 - protein, 9 aa, Homo sapiens
RNYLRSMRR

SEQ ID NO: 8664 - protein, 9 aa, Homo sapiens
RSMRRKSFR

SEQ ID NO: 8665 - protein, 9 aa, Homo sapiens
SMRRKSFRS

SEQ ID NO: 8666 - protein, 9 aa, Homo sapiens
LYRNYLRSM

SEQ ID NO: 8667 - protein, 9 aa, Homo sapiens
LRSMRRKSF

SEQ ID NO: 8668 - protein, 9 aa, Homo sapiens
HATHYRGTW

SEQ ID NO: 8669 - protein, 9 aa, Homo sapiens
THYRGTWYL

SEQ ID NO: 8670 - protein, 9 aa, Homo sapiens
TARRHGRYG

SEQ ID NO: 8671 - protein, 9 aa, Homo sapiens
IMKNFPYYR

SEQ ID NO: 8672 - protein, 9 aa, Homo sapiens
NLLRLGPAR

SEQ ID NO: 8673 - protein, 9 aa, Homo sapiens
QSLSVRALQ

SEQ ID NO: 8674 - protein, 9 aa, Homo sapiens
LSVRALQEM

SEQ ID NO: 8675 - protein, 9 aa, Homo sapiens
EIYHTKKNY

SEQ ID NO: 8676 - protein, 9 aa, Homo sapiens
TILEEVNYR

SEQ ID NO: 8677 - protein, 9 aa, Homo sapiens
KSHLYNHMK

SEQ ID NO: 8678 - protein, 9 aa, Homo sapiens
RPQGFAAIR

SEQ ID NO: 8679 - protein, 9 aa, Homo sapiens
GKWSDEACR

SEQ ID NO: 8680 - protein, 9 aa, Homo sapiens
SDEACRSSK

SEQ ID NO: 8681 - protein, 9 aa, Homo sapiens
DVNTARQRR

SEQ ID NO: 8682 - protein, 9 aa, Homo sapiens
LGMEPRYAR

SEQ ID NO: 8683 - protein, 9 aa, Homo sapiens
NRRPILTII

SEQ ID NO: 8684 - protein, 9 aa, Homo sapiens
DVIVHITLH

SEQ ID NO: 8685 - protein, 9 aa, Homo sapiens
SSLQLPRPR

SEQ ID NO: 8686 - protein, 9 aa, Homo sapiens
LQLPRPRPR

SEQ ID NO: 8687 - protein, 9 aa, Homo sapiens
FNANHPLLL

SEQ ID NO: 8688 - protein, 9 aa, Homo sapiens
GTVYYESQR

SEQ ID NO: 8689 - protein, 9 aa, Homo sapiens
TARNLICER

SEQ ID NO: 8690 - protein, 9 aa, Homo sapiens
STFSGFLVF

SEQ ID NO: 8691 - protein, 9 aa, Homo sapiens
STFSGFLVF

SEQ ID NO: 8692 - protein, 9 aa, Homo sapiens
MSLPEELPL

SEQ ID NO: 8693 - protein, 9 aa, Homo sapiens
MTEIMSSNR

SEQ ID NO: 8694 - protein, 9 aa, Homo sapiens
KTVYRHDKR

SEQ ID NO: 8695 - protein, 9 aa, Homo sapiens
TVHLQSRAR

SEQ ID NO: 8696 - protein, 9 aa, Homo sapiens
RARYTSEMR

SEQ ID NO: 8697 - protein, 9 aa, Homo sapiens
MAQLKCYYF

SEQ ID NO: 8698 - protein, 9 aa, Homo sapiens
AVPYPSAPR

SEQ ID NO: 8699 - protein, 9 aa, Homo sapiens
SVLGLGPAR

SEQ ID NO: 8700 - protein, 9 aa, Homo sapiens
NSSLILHQR

SEQ ID NO: 8701 - protein, 9 aa, Homo sapiens
HQRVHTGAR

SEQ ID NO: 8702 - protein, 9 aa, Homo sapiens
TLFPGAPVV

SEQ ID NO: 8703 - protein, 9 aa, Homo sapiens
FHGASGPVI

SEQ ID NO: 8704 - protein, 9 aa, Homo sapiens
GRWVLAWYR

SEQ ID NO: 8705 - protein, 9 aa, Homo sapiens
WVLAWYRAR

SEQ ID NO: 8706 - protein, 9 aa, Homo sapiens
VLAWYRARR

SEQ ID NO: 8707 - protein, 9 aa, Homo sapiens
MSGRWVLAW

SEQ ID NO: 8708 - protein, 9 aa, Homo sapiens
AVNSPVVSW

SEQ ID NO: 8709 - protein, 9 aa, Homo sapiens
GTLAAQALR

SEQ ID NO: 8710 - protein, 9 aa, Homo sapiens
RLTSVLTLL

SEQ ID NO: 8711 - protein, 9 aa, Homo sapiens
LTSVLTLLF

SEQ ID NO: 8712 - protein, 9 aa, Homo sapiens
PRLTSVLTL

SEQ ID NO: 8713 - protein, 9 aa, Homo sapiens
YSHEVYFDR

SEQ ID NO: 8714 - protein, 9 aa, Homo sapiens
VTYSHEVYF

SEQ ID NO: 8715 - protein, 9 aa, Homo sapiens
VYFDRDLVL

SEQ ID NO: 8716 - protein, 9 aa, Homo sapiens
WVIKESRGW

SEQ ID NO: 8717 - protein, 9 aa, Homo sapiens
TISKQIFPW

SEQ ID NO: 8718 - protein, 9 aa, Homo sapiens
MAISGGFIR

SEQ ID NO: 8719 - protein, 9 aa, Homo sapiens
AISGGFIRR

SEQ ID NO: 8720 - protein, 9 aa, Homo sapiens
GSKWLWLLF

SEQ ID NO: 8721 - protein, 9 aa, Homo sapiens
LGSKWLWLL

SEQ ID NO: 8722 - protein, 9 aa, Homo sapiens
WSRERDWDR

SEQ ID NO: 8723 - protein, 9 aa, Homo sapiens
RERDWDRPR

SEQ ID NO: 8724 - protein, 9 aa, Homo sapiens
WDRPREWDR

SEQ ID NO: 8725 - protein, 9 aa, Homo sapiens
KVLEHVPLL

SEQ ID NO: 8726 - protein, 9 aa, Homo sapiens
ILYGFLSYR

SEQ ID NO: 8727 - protein, 9 aa, Homo sapiens
RVENSKAEK

SEQ ID NO: 8728 - protein, 9 aa, Homo sapiens
VTAVLSVAG

SEQ ID NO: 8729 - protein, 9 aa, Homo sapiens
NSTRDFLFR

SEQ ID NO: 8730 - protein, 9 aa, Homo sapiens
ALSNMLQRR

SEQ ID NO: 8731 - protein, 9 aa, Homo sapiens
KSVREDGVF

SEQ ID NO: 8732 - protein, 9 aa, Homo sapiens
KILVTGWER

SEQ ID NO: 8733 - protein, 9 aa, Homo sapiens
YIPSHIQGN

SEQ ID NO: 8734 - protein, 9 aa, Homo sapiens
QFFQGIHEV

SEQ ID NO: 8735 - protein, 9 aa, Homo sapiens
DVNLGLIRY

SEQ ID NO: 8736 - protein, 9 aa, Homo sapiens
FTQEDVNLG

SEQ ID NO: 8737 - protein, 9 aa, Homo sapiens
GVKDLLVGR

SEQ ID NO: 8738 - protein, 9 aa, Homo sapiens
LAWDPRLWR

SEQ ID NO: 8739 - protein, 9 aa, Homo sapiens
DPRLWRTIR

SEQ ID NO: 8740 - protein, 9 aa, Homo sapiens
PRLWRTIRL

SEQ ID NO: 8741 - protein, 9 aa, Homo sapiens
LHHQKQGTL

SEQ ID NO: 8742 - protein, 9 aa, Homo sapiens
FSKKTGFWR

SEQ ID NO: 8743 - protein, 9 aa, Homo sapiens
ALQLVEVAR

SEQ ID NO: 8744 - protein, 9 aa, Homo sapiens
LQLVEVARR

SEQ ID NO: 8745 - protein, 9 aa, Homo sapiens
LIIAICAVS

SEQ ID NO: 8746 - protein, 9 aa, Homo sapiens
KCNACLSSP

SEQ ID NO: 8747 - protein, 9 aa, Homo sapiens
TSKIDYGNK

SEQ ID NO: 8748 - protein, 9 aa, Homo sapiens
KVYISAVLR

SEQ ID NO: 8749 - protein, 9 aa, Homo sapiens
ISAVLRDQR

SEQ ID NO: 8750 - protein, 9 aa, Homo sapiens
MVIVGLLVG

SEQ ID NO: 8751 - protein, 9 aa, Homo sapiens
DTFFEPISW

SEQ ID NO: 8752 - protein, 9 aa, Homo sapiens
ASCGFSSGR

SEQ ID NO: 8753 - protein, 9 aa, Homo sapiens
LVFYLIFGR

SEQ ID NO: 8754 - protein, 9 aa, Homo sapiens
FANDASSML

SEQ ID NO: 8755 - protein, 9 aa, Homo sapiens
RIAIQSKGR

SEQ ID NO: 8756 - protein, 9 aa, Homo sapiens
FHPPRAHLL

SEQ ID NO: 8757 - protein, 9 aa, Homo sapiens
GSAGSMGPR

SEQ ID NO: 8758 - protein, 9 aa, Homo sapiens
KLGAEEAAG

SEQ ID NO: 8759 - protein, 9 aa, Homo sapiens
IKYYEKDQR

SEQ ID NO: 8760 - protein, 9 aa, Homo sapiens
QTLNSVTPR

SEQ ID NO: 8761 - protein, 9 aa, Homo sapiens
EGQDIDELY

SEQ ID NO: 8762 - protein, 9 aa, Homo sapiens
KTTRSGEPF

SEQ ID NO: 8763 - protein, 9 aa, Homo sapiens
TRSGEPFII

SEQ ID NO: 8764 - protein, 9 aa, Homo sapiens
TSDKTKYYL

SEQ ID NO: 8765 - protein, 9 aa, Homo sapiens
SDKTKYYLQ

SEQ ID NO: 8766 - protein, 9 aa, Homo sapiens
SSTSPHRPR

SEQ ID NO: 8767 - protein, 9 aa, Homo sapiens
RSSTLFNHK

SEQ ID NO: 8768 - protein, 9 aa, Homo sapiens
KAFTRSSTL

SEQ ID NO: 8769 - protein, 9 aa, Homo sapiens
GARGLPGER

SEQ ID NO: 8770 - protein, 9 aa, Homo sapiens
TSLPEDTVR

SEQ ID NO: 8771 - protein, 9 aa, Homo sapiens
KDLAEDAPW

SEQ ID NO: 8772 - protein, 9 aa, Homo sapiens
KDLAEDAPW

SEQ ID NO: 8773 - protein, 9 aa, Homo sapiens
TGGNHVTAR

SEQ ID NO: 8774 - protein, 9 aa, Homo sapiens
SLHGSSLHR

SEQ ID NO: 8775 - protein, 9 aa, Homo sapiens
VLLEFYAPW

SEQ ID NO: 8776 - protein, 9 aa, Homo sapiens
RVFLRAINQ

SEQ ID NO: 8777 - protein, 9 aa, Homo sapiens
NREAHLAAM

SEQ ID NO: 8778 - protein, 9 aa, Homo sapiens
EVSKRYGGF

SEQ ID NO: 8779 - protein, 9 aa, Homo sapiens
GLKEGKDTK

SEQ ID NO: 8780 - protein, 9 aa, Homo sapiens
RMNFRRRRR

SEQ ID NO: 8781 - protein, 9 aa, Homo sapiens
FRMNFRRRR

SEQ ID NO: 8782 - protein, 9 aa, Homo sapiens
MNFRRRRRL

SEQ ID NO: 8783 - protein, 9 aa, Homo sapiens
RRRRRLMEL

SEQ ID NO: 8784 - protein, 9 aa, Homo sapiens
RRRRLMELL

SEQ ID NO: 8785 - protein, 9 aa, Homo sapiens
LAKKIIPSK

SEQ ID NO: 8786 - protein, 9 aa, Homo sapiens
RARGNVFMY

SEQ ID NO: 8787 - protein, 9 aa, Homo sapiens
LTLRSAASF

SEQ ID NO: 8788 - protein, 9 aa, Homo sapiens
LVNDEGWIR

SEQ ID NO: 8789 - protein, 9 aa, Homo sapiens
GALVNDEGW

SEQ ID NO: 8790 - protein, 9 aa, Homo sapiens
LVNDEGWIR

SEQ ID NO: 8791 - protein, 9 aa, Homo sapiens
GALVNDEGW

SEQ ID NO: 8792 - protein, 9 aa, Homo sapiens
LQLDNPTHM

SEQ ID NO: 8793 - protein, 9 aa, Homo sapiens
KEFLRLRRR

SEQ ID NO: 8794 - protein, 9 aa, Homo sapiens
MRQGRTLLH

SEQ ID NO: 8795 - protein, 9 aa, Homo sapiens
EPPEMIGPM

SEQ ID NO: 8796 - protein, 9 aa, Homo sapiens
EMIGPMRPE

SEQ ID NO: 8797 - protein, 9 aa, Homo sapiens
RRYVEPPEM

SEQ ID NO: 8798 - protein, 9 aa, Homo sapiens
SVNLFVVNK

SEQ ID NO: 8799 - protein, 9 aa, Homo sapiens
RRLSLKNAK

SEQ ID NO: 8800 - protein, 9 aa, Homo sapiens
GSGKSTIVR

SEQ ID NO: 8801 - protein, 9 aa, Homo sapiens
STIVRLLFR

SEQ ID NO: 8802 - protein, 9 aa, Homo sapiens
KSTIVRLLF

SEQ ID NO: 8803 - protein, 9 aa, Homo sapiens
LSTPVPPTR

SEQ ID NO: 8804 - protein, 9 aa, Homo sapiens
TRRELAENL

SEQ ID NO: 8805 - protein, 9 aa, Homo sapiens
RQEDGRRGL

SEQ ID NO: 8806 - protein, 9 aa, Homo sapiens
TSWAALPLL

SEQ ID NO: 8807 - protein, 9 aa, Homo sapiens
GSSSNEEEG

SEQ ID NO: 8808 - protein, 9 aa, Homo sapiens
HVVGTEIIR

SEQ ID NO: 8809 - protein, 9 aa, Homo sapiens
AYDLVKRKK

SEQ ID NO: 8810 - protein, 9 aa, Homo sapiens
SRLPALQMF

SEQ ID NO: 8811 - protein, 9 aa, Homo sapiens
SQVVATTAR

SEQ ID NO: 8812 - protein, 9 aa, Homo sapiens
QHRDHIVGV

SEQ ID NO: 8813 - protein, 9 aa, Homo sapiens
IIIIIVWVV

SEQ ID NO: 8814 - protein, 9 aa, Homo sapiens
CLRLGGLSV

SEQ ID NO: 8815 - protein, 9 aa, Homo sapiens
KDFNNSSHF

SEQ ID NO: 8816 - protein, 9 aa, Homo sapiens
APRAGLGHI

SEQ ID NO: 8817 - protein, 9 aa, Homo sapiens
SRLGHSSVF

SEQ ID NO: 8818 - protein, 9 aa, Homo sapiens
SVVRRFAHL

SEQ ID NO: 8819 - protein, 9 aa, Homo sapiens
VVRRFAHLL

SEQ ID NO: 8820 - protein, 9 aa, Homo sapiens
SVMKKCRKL

SEQ ID NO: 8821 - protein, 9 aa, Homo sapiens
MMTCEQAQL

SEQ ID NO: 8822 - protein, 9 aa, Homo sapiens
MTCEQAQLL

SEQ ID NO: 8823 - protein, 9 aa, Homo sapiens
MTCEQAQLL

SEQ ID NO: 8824 - protein, 9 aa, Homo sapiens
AMVYYMSTT

SEQ ID NO: 8825 - protein, 9 aa, Homo sapiens
MVYYMSTTI

SEQ ID NO: 8826 - protein, 9 aa, Homo sapiens
YMSTTIIAA

SEQ ID NO: 8827 - protein, 9 aa, Homo sapiens
MVYYMSTTI

SEQ ID NO: 8828 - protein, 9 aa, Homo sapiens
VYYMSTTII

SEQ ID NO: 8829 - protein, 9 aa, Homo sapiens
MSTTIIAAV

SEQ ID NO: 8830 - protein, 9 aa, Homo sapiens
SPPPCPPEI

SEQ ID NO: 8831 - protein, 9 aa, Homo sapiens
RLAVILPRI

SEQ ID NO: 8832 - protein, 9 aa, Homo sapiens
QRGDRLAVI

SEQ ID NO: 8833 - protein, 9 aa, Homo sapiens
QRGDRLAVI

SEQ ID NO: 8834 - protein, 9 aa, Homo sapiens
SIVHFPDAL

SEQ ID NO: 8835 - protein, 9 aa, Homo sapiens
VHFPDALEM

SEQ ID NO: 8836 - protein, 9 aa, Homo sapiens
VHFPDALEM

SEQ ID NO: 8837 - protein, 9 aa, Homo sapiens
GIIFSSFMA

SEQ ID NO: 8838 - protein, 9 aa, Homo sapiens
IIFSSFMAA

SEQ ID NO: 8839 - protein, 9 aa, Homo sapiens
TPVELYYTV

SEQ ID NO: 8840 - protein, 9 aa, Homo sapiens
YTVHPGNER

SEQ ID NO: 8841 - protein, 9 aa, Homo sapiens
NTFDLVALG

SEQ ID NO: 8842 - protein, 9 aa, Homo sapiens
VALGVGSTL

SEQ ID NO: 8843 - protein, 9 aa, Homo sapiens
KLNTITPVV

SEQ ID NO: 8844 - protein, 9 aa, Homo sapiens
AILQLVRRY

SEQ ID NO: 8845 - protein, 9 aa, Homo sapiens
VRRYKKLKV

SEQ ID NO: 8846 - protein, 9 aa, Homo sapiens
RAILQLVRR

SEQ ID NO: 8847 - protein, 9 aa, Homo sapiens
RQPEPPSLV

SEQ ID NO: 8848 - protein, 9 aa, Homo sapiens
RQPEPPSLV

SEQ ID NO: 8849 - protein, 9 aa, Homo sapiens
IGNWNEDVY

SEQ ID NO: 8850 - protein, 9 aa, Homo sapiens
VLSGPEATV

SEQ ID NO: 8851 - protein, 9 aa, Homo sapiens
GPEATVEHV

SEQ ID NO: 8852 - protein, 9 aa, Homo sapiens
PEATVEHVY

SEQ ID NO: 8853 - protein, 9 aa, Homo sapiens
ALLAINYSS

SEQ ID NO: 8854 - protein, 9 aa, Homo sapiens
LAINYSSEL

SEQ ID NO: 8855 - protein, 9 aa, Homo sapiens
YIERCLGHL

SEQ ID NO: 8856 - protein, 9 aa, Homo sapiens
YIERCLGHL

SEQ ID NO: 8857 - protein, 9 aa, Homo sapiens
MADRGEARL

SEQ ID NO: 8858 - protein, 9 aa, Homo sapiens
GSDSDESVY

SEQ ID NO: 8859 - protein, 9 aa, Homo sapiens
DSDESVYKV

SEQ ID NO: 8860 - protein, 9 aa, Homo sapiens
PGFECSGIV

SEQ ID NO: 8861 - protein, 9 aa, Homo sapiens
MKYERLARI

SEQ ID NO: 8862 - protein, 9 aa, Homo sapiens
MKYERLARI

SEQ ID NO: 8863 - protein, 9 aa, Homo sapiens
HAPDKEPEL

SEQ ID NO: 8864 - protein, 9 aa, Homo sapiens
KRHARVTVK

SEQ ID NO: 8865 - protein, 9 aa, Homo sapiens
NCKECGKSF

SEQ ID NO: 8866 - protein, 9 aa, Homo sapiens
RRRELTDRL

SEQ ID NO: 8867 - protein, 9 aa, Homo sapiens
LAAAKCRNR

SEQ ID NO: 8868 - protein, 9 aa, Homo sapiens
VTWNPHKMM

SEQ ID NO: 8869 - protein, 9 aa, Homo sapiens
RGARNARVL

SEQ ID NO: 8870 - protein, 9 aa, Homo sapiens
LTLSHAHEV

SEQ ID NO: 8871 - protein, 9 aa, Homo sapiens
LTLSHAHEV

SEQ ID NO: 8872 - protein, 9 aa, Homo sapiens
LTLSHAHEV

SEQ ID NO: 8873 - protein, 9 aa, Homo sapiens
MAAQPPRGI

SEQ ID NO: 8874 - protein, 9 aa, Homo sapiens
YVNSHSLFV

SEQ ID NO: 8875 - protein, 9 aa, Homo sapiens
FVWVCDRSY

SEQ ID NO: 8876 - protein, 9 aa, Homo sapiens
YVNSHSLFV

SEQ ID NO: 8877 - protein, 9 aa, Homo sapiens
YVNSHSLFV

SEQ ID NO: 8878 - protein, 9 aa, Homo sapiens
VTPEGLQMV

SEQ ID NO: 8879 - protein, 9 aa, Homo sapiens
SLEHLDLSY

SEQ ID NO: 8880 - protein, 9 aa, Homo sapiens
DSFSSLGSL

SEQ ID NO: 8881 - protein, 9 aa, Homo sapiens
ALIAILLCI

SEQ ID NO: 8882 - protein, 9 aa, Homo sapiens
LSTGALIAI

SEQ ID NO: 8883 - protein, 9 aa, Homo sapiens
SPVYSSSPV

SEQ ID NO: 8884 - protein, 9 aa, Homo sapiens
QLFTFHEAV

SEQ ID NO: 8885 - protein, 9 aa, Homo sapiens
FHEAVSQMV

SEQ ID NO: 8886 - protein, 9 aa, Homo sapiens
QLFTFHEAV

SEQ ID NO: 8887 - protein, 9 aa, Homo sapiens
FTFHEAVSQ

SEQ ID NO: 8888 - protein, 9 aa, Homo sapiens
FHEAVSQMV

SEQ ID NO: 8889 - protein, 9 aa, Homo sapiens
MIATVDLKV

SEQ ID NO: 8890 - protein, 9 aa, Homo sapiens
TLRKRLYEE

SEQ ID NO: 8891 - protein, 9 aa, Homo sapiens
TLRKRLYEE

SEQ ID NO: 8892 - protein, 9 aa, Homo sapiens
STRTCPRDC

SEQ ID NO: 8893 - protein, 9 aa, Homo sapiens
VQCSTSLYL

SEQ ID NO: 8894 - protein, 9 aa, Homo sapiens
STSLYLSLV

SEQ ID NO: 8895 - protein, 9 aa, Homo sapiens
SLYLSLVTL

SEQ ID NO: 8896 - protein, 9 aa, Homo sapiens
SLYLSLVTL

SEQ ID NO: 8897 - protein, 9 aa, Homo sapiens
QKPPRFSQL

SEQ ID NO: 8898 - protein, 9 aa, Homo sapiens
FTTSNIRKV

SEQ ID NO: 8899 - protein, 9 aa, Homo sapiens
FTTSNIRKV

SEQ ID NO: 8900 - protein, 9 aa, Homo sapiens
KVIALTLDL

SEQ ID NO: 8901 - protein, 9 aa, Homo sapiens
FSGKKVIAL

SEQ ID NO: 8902 - protein, 9 aa, Homo sapiens
FSGKKVIAL

SEQ ID NO: 8903 - protein, 9 aa, Homo sapiens
LSSASIFHL

SEQ ID NO: 8904 - protein, 9 aa, Homo sapiens
TAIPDFHAV

SEQ ID NO: 8905 - protein, 9 aa, Homo sapiens
TAIPDFHAV

SEQ ID NO: 8906 - protein, 9 aa, Homo sapiens
KHFKNCTSI

SEQ ID NO: 8907 - protein, 9 aa, Homo sapiens
KHFKNCTSI

SEQ ID NO: 8908 - protein, 9 aa, Homo sapiens
KHFKNCTSI

SEQ ID NO: 8909 - protein, 9 aa, Homo sapiens
LMPYCKSLD

SEQ ID NO: 8910 - protein, 9 aa, Homo sapiens
MPYCKSLDI

SEQ ID NO: 8911 - protein, 9 aa, Homo sapiens
MPYCKSLDI

SEQ ID NO: 8912 - protein, 9 aa, Homo sapiens
FSLSTPSPL

SEQ ID NO: 8913 - protein, 9 aa, Homo sapiens
SEFSAGSIV

SEQ ID NO: 8914 - protein, 9 aa, Homo sapiens
SEFSAGSIV

SEQ ID NO: 8915 - protein, 9 aa, Homo sapiens
HVTRRTPDY

SEQ ID NO: 8916 - protein, 9 aa, Homo sapiens
NNMSTPLPA

SEQ ID NO: 8917 - protein, 9 aa, Homo sapiens
NMSTPLPAI

SEQ ID NO: 8918 - protein, 9 aa, Homo sapiens
CAVPISTSL

SEQ ID NO: 8919 - protein, 9 aa, Homo sapiens
ISTSLIKQI

SEQ ID NO: 8920 - protein, 9 aa, Homo sapiens
LIKQIATKV

SEQ ID NO: 8921 - protein, 9 aa, Homo sapiens
FLPGTLALG

SEQ ID NO: 8922 - protein, 9 aa, Homo sapiens
LPGTLALGV

SEQ ID NO: 8923 - protein, 9 aa, Homo sapiens
PGTLALGVY

SEQ ID NO: 8924 - protein, 9 aa, Homo sapiens
AIPEKYGAV

SEQ ID NO: 8925 - protein, 9 aa, Homo sapiens
RHEGYLGAI

SEQ ID NO: 8926 - protein, 9 aa, Homo sapiens
QAKNQAYAM

SEQ ID NO: 8927 - protein, 9 aa, Homo sapiens
WIASESWAI

SEQ ID NO: 8928 - protein, 9 aa, Homo sapiens
LPPDRCLPF

SEQ ID NO: 8929 - protein, 9 aa, Homo sapiens
MNMHEIYTV

SEQ ID NO: 8930 - protein, 9 aa, Homo sapiens
NMHEIYTVL

SEQ ID NO: 8931 - protein, 9 aa, Homo sapiens
SVMNMHEIY

SEQ ID NO: 8932 - protein, 9 aa, Homo sapiens
MNMHEIYTV

SEQ ID NO: 8933 - protein, 9 aa, Homo sapiens
LLAEKRRQA

SEQ ID NO: 8934 - protein, 9 aa, Homo sapiens
LAEKRRQAR

SEQ ID NO: 8935 - protein, 9 aa, Homo sapiens
DRLQAAHLL

SEQ ID NO: 8936 - protein, 9 aa, Homo sapiens
YTNRAAAQY

SEQ ID NO: 8937 - protein, 9 aa, Homo sapiens
EMAEVTKIY

SEQ ID NO: 8938 - protein, 9 aa, Homo sapiens
FTINNGTGW

SEQ ID NO: 8939 - protein, 9 aa, Homo sapiens
QVFKLSTCD

SEQ ID NO: 8940 - protein, 9 aa, Homo sapiens
THAEAQAAI

SEQ ID NO: 8941 - protein, 9 aa, Homo sapiens
KIDRQDQSY

SEQ ID NO: 8942 - protein, 9 aa, Homo sapiens
DRQDQSYHY

SEQ ID NO: 8943 - protein, 9 aa, Homo sapiens
SHYGKIDRQ

SEQ ID NO: 8944 - protein, 9 aa, Homo sapiens
DTQDQSSHY

SEQ ID NO: 8945 - protein, 9 aa, Homo sapiens
YHYGQTDRQ

SEQ ID NO: 8946 - protein, 9 aa, Homo sapiens
THSGHTHGQ

SEQ ID NO: 8947 - protein, 9 aa, Homo sapiens
SSSGQYSGF

SEQ ID NO: 8948 - protein, 9 aa, Homo sapiens
SPAQCLPPA

SEQ ID NO: 8949 - protein, 9 aa, Homo sapiens
STNINNQES

SEQ ID NO: 8950 - protein, 9 aa, Homo sapiens
INNQESQEL

SEQ ID NO: 8951 - protein, 9 aa, Homo sapiens
YSLERDQLI

SEQ ID NO: 8952 - protein, 9 aa, Homo sapiens
RPVMKLSCI

SEQ ID NO: 8953 - protein, 9 aa, Homo sapiens
CTSQYFLWY

SEQ ID NO: 8954 - protein, 9 aa, Homo sapiens
CTSQYFLWY

SEQ ID NO: 8955 - protein, 9 aa, Homo sapiens
YPLDIPLNT

SEQ ID NO: 8956 - protein, 9 aa, Homo sapiens
YAQDALRVL

SEQ ID NO: 8957 - protein, 9 aa, Homo sapiens
KADTKAQTD

SEQ ID NO: 8958 - protein, 9 aa, Homo sapiens
TDIDSPQNL

SEQ ID NO: 8959 - protein, 9 aa, Homo sapiens
CPTCRKKLV

SEQ ID NO: 8960 - protein, 9 aa, Homo sapiens
LPEGDALRY

SEQ ID NO: 8961 - protein, 9 aa, Homo sapiens
LPEGDALRY

SEQ ID NO: 8962 - protein, 9 aa, Homo sapiens
SHLTRHRRI

SEQ ID NO: 8963 - protein, 9 aa, Homo sapiens
TRHRRIHTG

SEQ ID NO: 8964 - protein, 9 aa, Homo sapiens
FAVYDQSAT

SEQ ID NO: 8965 - protein, 9 aa, Homo sapiens
YLVPISISY

SEQ ID NO: 8966 - protein, 9 aa, Homo sapiens
QPGPLTLEL

SEQ ID NO: 8967 - protein, 9 aa, Homo sapiens
SVLTKHKKI

SEQ ID NO: 8968 - protein, 9 aa, Homo sapiens
HLKLIVDAF

SEQ ID NO: 8969 - protein, 9 aa, Homo sapiens
STGSHLKLI

SEQ ID NO: 8970 - protein, 9 aa, Homo sapiens
YPFFRGVTI

SEQ ID NO: 8971 - protein, 9 aa, Homo sapiens
TTKPKSRSA

SEQ ID NO: 8972 - protein, 9 aa, Homo sapiens
SSSATVKIL

SEQ ID NO: 8973 - protein, 9 aa, Homo sapiens
WIASKFQNF

SEQ ID NO: 8974 - protein, 9 aa, Homo sapiens
THNNAVVKM

SEQ ID NO: 8975 - protein, 9 aa, Homo sapiens
SSLAYKYVI

SEQ ID NO: 8976 - protein, 9 aa, Homo sapiens
SNMVRAAAE

SEQ ID NO: 8977 - protein, 9 aa, Homo sapiens
NMVRAAAEL

SEQ ID NO: 8978 - protein, 9 aa, Homo sapiens
SRARDSNMV

SEQ ID NO: 8979 - protein, 9 aa, Homo sapiens
VRAAAELAL

SEQ ID NO: 8980 - protein, 9 aa, Homo sapiens
YPSYSHCVW

SEQ ID NO: 8981 - protein, 9 aa, Homo sapiens
SHCVWRISV

SEQ ID NO: 8982 - protein, 9 aa, Homo sapiens
FPPCAIKCF

SEQ ID NO: 8983 - protein, 9 aa, Homo sapiens
YFFKESLVF

SEQ ID NO: 8984 - protein, 9 aa, Homo sapiens
DRRQKLIYF

SEQ ID NO: 8985 - protein, 9 aa, Homo sapiens
LGPGHLEML

SEQ ID NO: 8986 - protein, 9 aa, Homo sapiens
EAHAGSPSL

SEQ ID NO: 8987 - protein, 9 aa, Homo sapiens
LVARSPGPD

SEQ ID NO: 8988 - protein, 9 aa, Homo sapiens
LVARSPGPD

SEQ ID NO: 8989 - protein, 9 aa, Homo sapiens
DRGPRAVFL

SEQ ID NO: 8990 - protein, 9 aa, Homo sapiens
NVIPHTYCD

SEQ ID NO: 8991 - protein, 9 aa, Homo sapiens
IPHTYCDHM

SEQ ID NO: 8992 - protein, 9 aa, Homo sapiens
KHNPRGTHL

SEQ ID NO: 8993 - protein, 9 aa, Homo sapiens
EPSQGTEEV

SEQ ID NO: 8994 - protein, 9 aa, Homo sapiens
SLALRILFY

SEQ ID NO: 8995 - protein, 9 aa, Homo sapiens
IHSSLALRI

SEQ ID NO: 8996 - protein, 9 aa, Homo sapiens
LSETKTISY

SEQ ID NO: 8997 - protein, 9 aa, Homo sapiens
LSETKTISY

SEQ ID NO: 8998 - protein, 9 aa, Homo sapiens
VMMLFLTIL

SEQ ID NO: 8999 - protein, 9 aa, Homo sapiens
FSTEIVVMM

SEQ ID NO: 9000 - protein, 9 aa, Homo sapiens
FSTEIVVMM

SEQ ID NO: 9001 - protein, 9 aa, Homo sapiens
CHGTMSILM

SEQ ID NO: 9002 - protein, 9 aa, Homo sapiens
LANGEVRIY

SEQ ID NO: 9003 - protein, 9 aa, Homo sapiens
VRIYRDKAL

SEQ ID NO: 9004 - protein, 9 aa, Homo sapiens
LPEMASVGL

SEQ ID NO: 9005 - protein, 9 aa, Homo sapiens
LPRAKRKSV

SEQ ID NO: 9006 - protein, 9 aa, Homo sapiens
IPVDSAVAV

SEQ ID NO: 9007 - protein, 9 aa, Homo sapiens
YPGMRSQEL

SEQ ID NO: 9008 - protein, 9 aa, Homo sapiens
YPGMRSQEL

SEQ ID NO: 9009 - protein, 9 aa, Homo sapiens
MRSQELTKI

SEQ ID NO: 9010 - protein, 9 aa, Homo sapiens
SDEEHEQEL

SEQ ID NO: 9011 - protein, 9 aa, Homo sapiens
SRMSFRSSF

SEQ ID NO: 9012 - protein, 9 aa, Homo sapiens
SFRSSFASL

SEQ ID NO: 9013 - protein, 9 aa, Homo sapiens
SSFASLFSF

SEQ ID NO: 9014 - protein, 9 aa, Homo sapiens
SRMSFRSSF

SEQ ID NO: 9015 - protein, 9 aa, Homo sapiens
FRSSFASLF

SEQ ID NO: 9016 - protein, 9 aa, Homo sapiens
AAAAAPPGL

SEQ ID NO: 9017 - protein, 9 aa, Homo sapiens
LRLRLLLLL

SEQ ID NO: 9018 - protein, 9 aa, Homo sapiens
FLKAVVLTL

SEQ ID NO: 9019 - protein, 9 aa, Homo sapiens
MLNPLIYSL

SEQ ID NO: 9020 - protein, 9 aa, Homo sapiens
SLRNKDVKV

SEQ ID NO: 9021 - protein, 9 aa, Homo sapiens
MLNPLIYSL

SEQ ID NO: 9022 - protein, 9 aa, Homo sapiens
FLRIKRRVK

SEQ ID NO: 9023 - protein, 9 aa, Homo sapiens
RIKRRVKSV

SEQ ID NO: 9024 - protein, 9 aa, Homo sapiens
KRRVKSVVL

SEQ ID NO: 9025 - protein, 9 aa, Homo sapiens
GHCAGQREV

SEQ ID NO: 9026 - protein, 9 aa, Homo sapiens
SRSASGRKI

SEQ ID NO: 9027 - protein, 9 aa, Homo sapiens
VYIDETRQI

SEQ ID NO: 9028 - protein, 9 aa, Homo sapiens
YIDETRQIL

SEQ ID NO: 9029 - protein, 9 aa, Homo sapiens
YLKLRFLID

SEQ ID NO: 9030 - protein, 9 aa, Homo sapiens
THGKEMDLL

SEQ ID NO: 9031 - protein, 9 aa, Homo sapiens
FPGQVAGTT

SEQ ID NO: 9032 - protein, 9 aa, Homo sapiens
KARKYLHSW

SEQ ID NO: 9033 - protein, 9 aa, Homo sapiens
ARKYLHSWM

SEQ ID NO: 9034 - protein, 9 aa, Homo sapiens
FLRKFIASF

SEQ ID NO: 9035 - protein, 9 aa, Homo sapiens
VQDLRSDLN

SEQ ID NO: 9036 - protein, 9 aa, Homo sapiens
LAGVLTIAM

SEQ ID NO: 9037 - protein, 9 aa, Homo sapiens
LLTTRDKSV

SEQ ID NO: 9038 - protein, 9 aa, Homo sapiens
IPSAARVHY

SEQ ID NO: 9039 - protein, 9 aa, Homo sapiens
QPTETRFVD

SEQ ID NO: 9040 - protein, 9 aa, Homo sapiens
TRFVDGRAI

SEQ ID NO: 9041 - protein, 9 aa, Homo sapiens
FFDYKKMTI

SEQ ID NO: 9042 - protein, 9 aa, Homo sapiens
ENEIRGLCL

SEQ ID NO: 9043 - protein, 9 aa, Homo sapiens
ERFDSLTDL

SEQ ID NO: 9044 - protein, 9 aa, Homo sapiens
WPEKVLDIL

SEQ ID NO: 9045 - protein, 9 aa, Homo sapiens
LPIGTPDYM

SEQ ID NO: 9046 - protein, 9 aa, Homo sapiens
FNYKKRQNL

SEQ ID NO: 9047 - protein, 9 aa, Homo sapiens
KRQNLDEIL

SEQ ID NO: 9048 - protein, 9 aa, Homo sapiens
IGWMSSHTD

SEQ ID NO: 9049 - protein, 9 aa, Homo sapiens
KRAAGVRLI

SEQ ID NO: 9050 - protein, 9 aa, Homo sapiens
YPTRNSIVM

SEQ ID NO: 9051 - protein, 9 aa, Homo sapiens
IFQDRGQEL

SEQ ID NO: 9052 - protein, 9 aa, Homo sapiens
KRIHTGEKL

SEQ ID NO: 9053 - protein, 9 aa, Homo sapiens
VHQRSHTGM

SEQ ID NO: 9054 - protein, 9 aa, Homo sapiens
SHTGMKPYV

SEQ ID NO: 9055 - protein, 9 aa, Homo sapiens
IIHMRTHSG

SEQ ID NO: 9056 - protein, 9 aa, Homo sapiens
IIHMRTHSG

SEQ ID NO: 9057 - protein, 9 aa, Homo sapiens
SPAFKVREF

SEQ ID NO: 9058 - protein, 9 aa, Homo sapiens
LARALPGAF

SEQ ID NO: 9059 - protein, 9 aa, Homo sapiens
LPGAFPTGA

SEQ ID NO: 9060 - protein, 9 aa, Homo sapiens
LDFLRTHQL

SEQ ID NO: 9061 - protein, 9 aa, Homo sapiens
SAAQRGHSL

SEQ ID NO: 9062 - protein, 9 aa, Homo sapiens
SAAQRGHSL

SEQ ID NO: 9063 - protein, 9 aa, Homo sapiens
SAAQRGHSL

SEQ ID NO: 9064 - protein, 9 aa, Homo sapiens
GHSLLSWSL

SEQ ID NO: 9065 - protein, 9 aa, Homo sapiens
LRKNQILII

SEQ ID NO: 9066 - protein, 9 aa, Homo sapiens
EALKKGGVL

SEQ ID NO: 9067 - protein, 9 aa, Homo sapiens
AHGHGREAV

SEQ ID NO: 9068 - protein, 9 aa, Homo sapiens
WLEAHYQEA

SEQ ID NO: 9069 - protein, 9 aa, Homo sapiens
QALWLEAHY

SEQ ID NO: 9070 - protein, 9 aa, Homo sapiens
GPGTCTLPL

SEQ ID NO: 9071 - protein, 9 aa, Homo sapiens
IHPDGEKVA

SEQ ID NO: 9072 - protein, 9 aa, Homo sapiens
THSAKDAKL

SEQ ID NO: 9073 - protein, 9 aa, Homo sapiens
DLIDEDLNF

SEQ ID NO: 9074 - protein, 9 aa, Homo sapiens
LVSECNYER

SEQ ID NO: 9075 - protein, 9 aa, Homo sapiens
ERWHKQRRV

SEQ ID NO: 9076 - protein, 9 aa, Homo sapiens
SEKQKLRAQ

SEQ ID NO: 9077 - protein, 9 aa, Homo sapiens
MIQIREDHM

SEQ ID NO: 9078 - protein, 9 aa, Homo sapiens
EDHMRFISE

SEQ ID NO: 9079 - protein, 9 aa, Homo sapiens
IREDHMRFI

SEQ ID NO: 9080 - protein, 9 aa, Homo sapiens
DHMRFISEL

SEQ ID NO: 9081 - protein, 9 aa, Homo sapiens
DASAARVAL

SEQ ID NO: 9082 - protein, 9 aa, Homo sapiens
GPGSIPLQD

SEQ ID NO: 9083 - protein, 9 aa, Homo sapiens
PPALRLRAL

SEQ ID NO: 9084 - protein, 9 aa, Homo sapiens
FPPALRLRA

SEQ ID NO: 9085 - protein, 9 aa, Homo sapiens
VPLDSYCND

SEQ ID NO: 9086 - protein, 9 aa, Homo sapiens
YCNDRSAEY

SEQ ID NO: 9087 - protein, 9 aa, Homo sapiens
LASGPDPAF

SEQ ID NO: 9088 - protein, 9 aa, Homo sapiens
RSFSGGQLA

SEQ ID NO: 9089 - protein, 9 aa, Homo sapiens
YRRDARAFF

SEQ ID NO: 9090 - protein, 9 aa, Homo sapiens
TLLKGFKIF

SEQ ID NO: 9091 - protein, 9 aa, Homo sapiens
VGDYFHMAY

SEQ ID NO: 9092 - protein, 9 aa, Homo sapiens
GSAIAYSAY

SEQ ID NO: 9093 - protein, 9 aa, Homo sapiens
SAYTFPDAL

SEQ ID NO: 9094 - protein, 9 aa, Homo sapiens
LPEKVARVF

SEQ ID NO: 9095 - protein, 9 aa, Homo sapiens
TRRILPEKV

SEQ ID NO: 9096 - protein, 9 aa, Homo sapiens
YCVNRFSSL

SEQ ID NO: 9097 - protein, 9 aa, Homo sapiens
PKLECSGVV

SEQ ID NO: 9098 - protein, 9 aa, Homo sapiens
FIVSKKPAL

SEQ ID NO: 9099 - protein, 9 aa, Homo sapiens
RRPGLVSAV

SEQ ID NO: 9100 - protein, 9 aa, Homo sapiens
QIREKLDQL

SEQ ID NO: 9101 - protein, 9 aa, Homo sapiens
RPRCLRTAV

SEQ ID NO: 9102 - protein, 9 aa, Homo sapiens
RPRCLRTAV

SEQ ID NO: 9103 - protein, 9 aa, Homo sapiens
IHFFRPRCL

SEQ ID NO: 9104 - protein, 9 aa, Homo sapiens
GLQKRGQQV

SEQ ID NO: 9105 - protein, 9 aa, Homo sapiens
ERGSKGFGF

SEQ ID NO: 9106 - protein, 9 aa, Homo sapiens
GGGAGRELV

SEQ ID NO: 9107 - protein, 9 aa, Homo sapiens
LPREDAFHI

SEQ ID NO: 9108 - protein, 9 aa, Homo sapiens
PREDAFHIF

SEQ ID NO: 9109 - protein, 9 aa, Homo sapiens
VPLLAGQLC

SEQ ID NO: 9110 - protein, 9 aa, Homo sapiens
SPWFTHITS

SEQ ID NO: 9111 - protein, 9 aa, Homo sapiens
SRSPWFTHI

SEQ ID NO: 9112 - protein, 9 aa, Homo sapiens
RLDAMFRAF

SEQ ID NO: 9113 - protein, 9 aa, Homo sapiens
EIYTHVTCA

SEQ ID NO: 9114 - protein, 9 aa, Homo sapiens
AHKEIYTHV

SEQ ID NO: 9115 - protein, 9 aa, Homo sapiens
FPTQRSDSI

SEQ ID NO: 9116 - protein, 9 aa, Homo sapiens
FPTQRSDSI

SEQ ID NO: 9117 - protein, 9 aa, Homo sapiens
LRQVRLNEI

SEQ ID NO: 9118 - protein, 9 aa, Homo sapiens
NRVKSLRQV

SEQ ID NO: 9119 - protein, 9 aa, Homo sapiens
LRQVRLNEI

SEQ ID NO: 9120 - protein, 9 aa, Homo sapiens
FVTVQGRAI

SEQ ID NO: 9121 - protein, 9 aa, Homo sapiens
NRMLTSGVV

SEQ ID NO: 9122 - protein, 9 aa, Homo sapiens
RARLRLWGV

SEQ ID NO: 9123 - protein, 9 aa, Homo sapiens
FRENQQITV

SEQ ID NO: 9124 - protein, 9 aa, Homo sapiens
SYSPTSPSY

SEQ ID NO: 9125 - protein, 9 aa, Homo sapiens
YVIEYAACD

SEQ ID NO: 9126 - protein, 9 aa, Homo sapiens
EYAACDATY

SEQ ID NO: 9127 - protein, 9 aa, Homo sapiens
CDATYNEIV

SEQ ID NO: 9128 - protein, 9 aa, Homo sapiens
VRGPYIPAL

SEQ ID NO: 9129 - protein, 9 aa, Homo sapiens
FPASVPMGA

SEQ ID NO: 9130 - protein, 9 aa, Homo sapiens
EHELVLHQL

SEQ ID NO: 9131 - protein, 9 aa, Homo sapiens
MPMGGMMPP

SEQ ID NO: 9132 - protein, 9 aa, Homo sapiens
IHKGVYQEL

SEQ ID NO: 9133 - protein, 9 aa, Homo sapiens
LERPRGAPL

SEQ ID NO: 9134 - protein, 9 aa, Homo sapiens
RRLERPRGA

SEQ ID NO: 9135 - protein, 9 aa, Homo sapiens
PLKEYYTLM

SEQ ID NO: 9136 - protein, 9 aa, Homo sapiens
SLRLQSSSA

SEQ ID NO: 9137 - protein, 9 aa, Homo sapiens
PRSALPRLL

SEQ ID NO: 9138 - protein, 9 aa, Homo sapiens
PRLLLPLLL

SEQ ID NO: 9139 - protein, 9 aa, Homo sapiens
LDSPNPEEL

SEQ ID NO: 9140 - protein, 9 aa, Homo sapiens
QLQQKQQDL

SEQ ID NO: 9141 - protein, 9 aa, Homo sapiens
RDQDRGQQL

SEQ ID NO: 9142 - protein, 9 aa, Homo sapiens
DPSFADLIH

SEQ ID NO: 9143 - protein, 9 aa, Homo sapiens
FWWGEDPSF

SEQ ID NO: 9144 - protein, 9 aa, Homo sapiens
CALPYHEVY

SEQ ID NO: 9145 - protein, 9 aa, Homo sapiens
LPYHEVYTI

SEQ ID NO: 9146 - protein, 9 aa, Homo sapiens
NPDSKLSQL

SEQ ID NO: 9147 - protein, 9 aa, Homo sapiens
FAMARLRFL

SEQ ID NO: 9148 - protein, 9 aa, Homo sapiens
MARLRFLKL

SEQ ID NO: 9149 - protein, 9 aa, Homo sapiens
FAMARLRFL

SEQ ID NO: 9150 - protein, 9 aa, Homo sapiens
SSRKRHPAG

SEQ ID NO: 9151 - protein, 9 aa, Homo sapiens
AYACNTSTL

SEQ ID NO: 9152 - protein, 9 aa, Homo sapiens
LPDEFSPAV

SEQ ID NO: 9153 - protein, 9 aa, Homo sapiens
SPALHEREL

SEQ ID NO: 9154 - protein, 9 aa, Homo sapiens
FPANCDACA

SEQ ID NO: 9155 - protein, 9 aa, Homo sapiens
YSILQGQPY

SEQ ID NO: 9156 - protein, 9 aa, Homo sapiens
YSILQGQPY

SEQ ID NO: 9157 - protein, 9 aa, Homo sapiens
YLRFLDYEM

SEQ ID NO: 9158 - protein, 9 aa, Homo sapiens
HPNQVSPVK

SEQ ID NO: 9159 - protein, 9 aa, Homo sapiens
NLIHSTSAM

SEQ ID NO: 9160 - protein, 9 aa, Homo sapiens
SIMDVRSRV

SEQ ID NO: 9161 - protein, 9 aa, Homo sapiens
RRHDGSVDF

SEQ ID NO: 9162 - protein, 9 aa, Homo sapiens
TAISKFLLL

SEQ ID NO: 9163 - protein, 9 aa, Homo sapiens
DEMGLGKTI

SEQ ID NO: 9164 - protein, 9 aa, Homo sapiens
PAFPAKDPD

SEQ ID NO: 9165 - protein, 9 aa, Homo sapiens
FPAKDPDPP

SEQ ID NO: 9166 - protein, 9 aa, Homo sapiens
FKFMKRHTL

SEQ ID NO: 9167 - protein, 9 aa, Homo sapiens
FKFMKRHTL

SEQ ID NO: 9168 - protein, 9 aa, Homo sapiens
RNMEKHSTI

SEQ ID NO: 9169 - protein, 9 aa, Homo sapiens
RNMEKHSTI

SEQ ID NO: 9170 - protein, 9 aa, Homo sapiens
KHSTISLPF

SEQ ID NO: 9171 - protein, 9 aa, Homo sapiens
RNMEKHSTI

SEQ ID NO: 9172 - protein, 9 aa, Homo sapiens
VRQGRLEFA

SEQ ID NO: 9173 - protein, 9 aa, Homo sapiens
QPVLVSVPM

SEQ ID NO: 9174 - protein, 9 aa, Homo sapiens
VVQPVQLAF

SEQ ID NO: 9175 - protein, 9 aa, Homo sapiens
QPVQLAFQQ

SEQ ID NO: 9176 - protein, 9 aa, Homo sapiens
IVHTGEKPY

SEQ ID NO: 9177 - protein, 9 aa, Homo sapiens
IIHTGAKPY

SEQ ID NO: 9178 - protein, 9 aa, Homo sapiens
IIHSGEKPY

SEQ ID NO: 9179 - protein, 9 aa, Homo sapiens
KAFNQSSIL

SEQ ID NO: 9180 - protein, 9 aa, Homo sapiens
KAFNQSSIL

SEQ ID NO: 9181 - protein, 9 aa, Homo sapiens
RAFNRSSHL

SEQ ID NO: 9182 - protein, 9 aa, Homo sapiens
RAFNRSSHL

SEQ ID NO: 9183 - protein, 9 aa, Homo sapiens
IIHAGEKPY

SEQ ID NO: 9184 - protein, 9 aa, Homo sapiens
IIHTGEKSY

SEQ ID NO: 9185 - protein, 9 aa, Homo sapiens
SNLTKHKIV

SEQ ID NO: 9186 - protein, 9 aa, Homo sapiens
IVHTGEKPY

SEQ ID NO: 9187 - protein, 9 aa, Homo sapiens
IIHTGEKLY

SEQ ID NO: 9188 - protein, 9 aa, Homo sapiens
IIHTEEKPY

SEQ ID NO: 9189 - protein, 9 aa, Homo sapiens
IIHTGEKPN

SEQ ID NO: 9190 - protein, 9 aa, Homo sapiens
RIHTGEKPY

SEQ ID NO: 9191 - protein, 9 aa, Homo sapiens
IIHTGEKRY

SEQ ID NO: 9192 - protein, 9 aa, Homo sapiens
IIHTGKKPY

SEQ ID NO: 9193 - protein, 9 aa, Homo sapiens
IIHTGKKPY

SEQ ID NO: 9194 - protein, 9 aa, Homo sapiens
IIHTGEKSY

SEQ ID NO: 9195 - protein, 9 aa, Homo sapiens
IIHTGKKPY

SEQ ID NO: 9196 - protein, 9 aa, Homo sapiens
KRKDNTIGV

SEQ ID NO: 9197 - protein, 9 aa, Homo sapiens
RHLQPGMVL

SEQ ID NO: 9198 - protein, 9 aa, Homo sapiens
VARHGPMCH

SEQ ID NO: 9199 - protein, 9 aa, Homo sapiens
ARHGPMCHL

SEQ ID NO: 9200 - protein, 9 aa, Homo sapiens
RHGPMCHLM

SEQ ID NO: 9201 - protein, 9 aa, Homo sapiens
QIHTGEKLY

SEQ ID NO: 9202 - protein, 9 aa, Homo sapiens
YYRSGEVLY

SEQ ID NO: 9203 - protein, 9 aa, Homo sapiens
FTYYRSGEV

SEQ ID NO: 9204 - protein, 9 aa, Homo sapiens
TYYRSGEVL

SEQ ID NO: 9205 - protein, 9 aa, Homo sapiens
YRSGEVLYL

SEQ ID NO: 9206 - protein, 9 aa, Homo sapiens
LHGPDLPRI

SEQ ID NO: 9207 - protein, 9 aa, Homo sapiens
LHGPDLPRI

SEQ ID NO: 9208 - protein, 9 aa, Homo sapiens
ETIRRFGRL

SEQ ID NO: 9209 - protein, 9 aa, Homo sapiens
RRFGRLDCV

SEQ ID NO: 9210 - protein, 9 aa, Homo sapiens
CQQSRRQRI

SEQ ID NO: 9211 - protein, 9 aa, Homo sapiens
VKGWRPRRL

SEQ ID NO: 9212 - protein, 9 aa, Homo sapiens
LPPLLSEIW

SEQ ID NO: 9213 - protein, 9 aa, Homo sapiens
GPRRRFLCG

SEQ ID NO: 9214 - protein, 9 aa, Homo sapiens
MLENYRNLL

SEQ ID NO: 9215 - protein, 9 aa, Homo sapiens
VLSQRSEVL

SEQ ID NO: 9216 - protein, 9 aa, Homo sapiens
FHAHYIAQC

SEQ ID NO: 9217 - protein, 9 aa, Homo sapiens
VTSVHGGTY

SEQ ID NO: 9218 - protein, 9 aa, Homo sapiens
FPMSPVTSV

SEQ ID NO: 9219 - protein, 9 aa, Homo sapiens
VTSVHGGTY

SEQ ID NO: 9220 - protein, 9 aa, Homo sapiens
NLLQEEASY

SEQ ID NO: 9221 - protein, 9 aa, Homo sapiens
TVHTGERPY

SEQ ID NO: 9222 - protein, 9 aa, Homo sapiens
QVVEDGYEF

SEQ ID NO: 9223 - protein, 9 aa, Homo sapiens
LHYDKLPGS

SEQ ID NO: 9224 - protein, 9 aa, Homo sapiens
EAARGQQPH

SEQ ID NO: 9225 - protein, 9 aa, Homo sapiens
LPSGSSVPG

SEQ ID NO: 9226 - protein, 9 aa, Homo sapiens
PATAAVSAM

SEQ ID NO: 9227 - protein, 9 aa, Homo sapiens
LHTPATAAV

SEQ ID NO: 9228 - protein, 9 aa, Homo sapiens
PATAAVSAM

SEQ ID NO: 9229 - protein, 9 aa, Homo sapiens
SHHINRWRI

SEQ ID NO: 9230 - protein, 9 aa, Homo sapiens
LQWNRIRSI

SEQ ID NO: 9231 - protein, 9 aa, Homo sapiens
LPGRAGGAA

SEQ ID NO: 9232 - protein, 9 aa, Homo sapiens
IGDEFNAYY

SEQ ID NO: 9233 - protein, 9 aa, Homo sapiens
PHSEKGPQA

SEQ ID NO: 9234 - protein, 9 aa, Homo sapiens
EGVEITVTF

SEQ ID NO: 9235 - protein, 9 aa, Homo sapiens
LPLVVVPGL

SEQ ID NO: 9236 - protein, 9 aa, Homo sapiens
TSIPGLRPY

SEQ ID NO: 9237 - protein, 9 aa, Homo sapiens
RPYPGLDQM

SEQ ID NO: 9238 - protein, 9 aa, Homo sapiens
FRVRAENRF

SEQ ID NO: 9239 - protein, 9 aa, Homo sapiens
STSSLKKFL

SEQ ID NO: 9240 - protein, 9 aa, Homo sapiens
LDDDTDVGY

SEQ ID NO: 9241 - protein, 9 aa, Homo sapiens
CPAGLPCAF

SEQ ID NO: 9242 - protein, 9 aa, Homo sapiens
LPCAFFAPV

SEQ ID NO: 9243 - protein, 9 aa, Homo sapiens
RFRKRTHSA

SEQ ID NO: 9244 - protein, 9 aa, Homo sapiens
RRREEEERR

SEQ ID NO: 9245 - protein, 9 aa, Homo sapiens
ERRKQEELL

SEQ ID NO: 9246 - protein, 9 aa, Homo sapiens
GPRSRVWAE

SEQ ID NO: 9247 - protein, 9 aa, Homo sapiens
WAWELSDLH

SEQ ID NO: 9248 - protein, 9 aa, Homo sapiens
MRLCWAWEL

SEQ ID NO: 9249 - protein, 9 aa, Homo sapiens
LPTGAAASA

SEQ ID NO: 9250 - protein, 9 aa, Homo sapiens
GAAASAPVM

SEQ ID NO: 9251 - protein, 9 aa, Homo sapiens
KLDLKRQYD

SEQ ID NO: 9252 - protein, 9 aa, Homo sapiens
DLKRQYDRV

SEQ ID NO: 9253 - protein, 9 aa, Homo sapiens
DRVAQLDQL

SEQ ID NO: 9254 - protein, 9 aa, Homo sapiens
LPAADATAL

SEQ ID NO: 9255 - protein, 9 aa, Homo sapiens
AADATALTL

SEQ ID NO: 9256 - protein, 9 aa, Homo sapiens
TPNLISTEF

SEQ ID NO: 9257 - protein, 9 aa, Homo sapiens
ISTEFSAEL

SEQ ID NO: 9258 - protein, 9 aa, Homo sapiens
SFLRGTTSY

SEQ ID NO: 9259 - protein, 9 aa, Homo sapiens
CQQEHIHEL

SEQ ID NO: 9260 - protein, 9 aa, Homo sapiens
EHIHELQEL

SEQ ID NO: 9261 - protein, 9 aa, Homo sapiens
APSPLTEEK

SEQ ID NO: 9262 - protein, 9 aa, Homo sapiens
APLHSRDLH

SEQ ID NO: 9263 - protein, 9 aa, Homo sapiens
LHSRDLHSM

SEQ ID NO: 9264 - protein, 9 aa, Homo sapiens
SRDLHSMIV

SEQ ID NO: 9265 - protein, 9 aa, Homo sapiens
LTGTFASRY

SEQ ID NO: 9266 - protein, 9 aa, Homo sapiens
DTMSYRDSY

SEQ ID NO: 9267 - protein, 9 aa, Homo sapiens
DTMSYRDSY

SEQ ID NO: 9268 - protein, 9 aa, Homo sapiens
AARIVDTPC

SEQ ID NO: 9269 - protein, 9 aa, Homo sapiens
TRAHAEERL

SEQ ID NO: 9270 - protein, 9 aa, Homo sapiens
NIYMQRMGI

SEQ ID NO: 9271 - protein, 9 aa, Homo sapiens
LSSRRRRRL

SEQ ID NO: 9272 - protein, 9 aa, Homo sapiens
SRRRRRLAL

SEQ ID NO: 9273 - protein, 9 aa, Homo sapiens
RRRRRLALF

SEQ ID NO: 9274 - protein, 9 aa, Homo sapiens
LSSRRRRRL

SEQ ID NO: 9275 - protein, 9 aa, Homo sapiens
RRRRRLALF

SEQ ID NO: 9276 - protein, 9 aa, Homo sapiens
LPPALETAR

SEQ ID NO: 9277 - protein, 9 aa, Homo sapiens
FPYLRNHSA

SEQ ID NO: 9278 - protein, 9 aa, Homo sapiens
HSAYNAPSF

SEQ ID NO: 9279 - protein, 9 aa, Homo sapiens
SANTGPAHY

SEQ ID NO: 9280 - protein, 9 aa, Homo sapiens
AHYMTEGHL

SEQ ID NO: 9281 - protein, 9 aa, Homo sapiens
HPHSPWIPS

SEQ ID NO: 9282 - protein, 9 aa, Homo sapiens
PHSPWIPSL

SEQ ID NO: 9283 - protein, 9 aa, Homo sapiens
LDFQLSDSY

SEQ ID NO: 9284 - protein, 9 aa, Homo sapiens
FQLSDSYLV

SEQ ID NO: 9285 - protein, 9 aa, Homo sapiens
YPNCPVTRF

SEQ ID NO: 9286 - protein, 9 aa, Homo sapiens
YPNCPVTRF

SEQ ID NO: 9287 - protein, 9 aa, Homo sapiens
CRPSSSVSL

SEQ ID NO: 9288 - protein, 9 aa, Homo sapiens
IREEHRQAL

SEQ ID NO: 9289 - protein, 9 aa, Homo sapiens
QHLSSPQGV

SEQ ID NO: 9290 - protein, 9 aa, Homo sapiens
LPYLSRRAL

SEQ ID NO: 9291 - protein, 9 aa, Homo sapiens
LPYLSRRAL

SEQ ID NO: 9292 - protein, 9 aa, Homo sapiens
RALENSSLM

SEQ ID NO: 9293 - protein, 9 aa, Homo sapiens
RRALENSSL

SEQ ID NO: 9294 - protein, 9 aa, Homo sapiens
RALENSSLM

SEQ ID NO: 9295 - protein, 9 aa, Homo sapiens
HSHELNGPC

SEQ ID NO: 9296 - protein, 9 aa, Homo sapiens
HSHELNGPC

SEQ ID NO: 9297 - protein, 9 aa, Homo sapiens
DAMEDSTSF

SEQ ID NO: 9298 - protein, 9 aa, Homo sapiens
RRWNQTCEL

SEQ ID NO: 9299 - protein, 9 aa, Homo sapiens
MAPEMDQFY

SEQ ID NO: 9300 - protein, 9 aa, Homo sapiens
VLMDQHMGF

SEQ ID NO: 9301 - protein, 9 aa, Homo sapiens
ERLDNGTWV

SEQ ID NO: 9302 - protein, 9 aa, Homo sapiens
FVYRQGCPF

SEQ ID NO: 9303 - protein, 9 aa, Homo sapiens
CWDTFVYRQ

SEQ ID NO: 9304 - protein, 9 aa, Homo sapiens
PTLTFVYLY

SEQ ID NO: 9305 - protein, 9 aa, Homo sapiens
YNANWELER

SEQ ID NO: 9306 - protein, 9 aa, Homo sapiens
SHNGSPLTS

SEQ ID NO: 9307 - protein, 9 aa, Homo sapiens
EPTPLPPPT

SEQ ID NO: 9308 - protein, 9 aa, Homo sapiens
DPETKPTSM

SEQ ID NO: 9309 - protein, 9 aa, Homo sapiens
YFKSLFRSG

SEQ ID NO: 9310 - protein, 9 aa, Homo sapiens
RPILTVPQM

SEQ ID NO: 9311 - protein, 9 aa, Homo sapiens
FISGSRVSM

SEQ ID NO: 9312 - protein, 9 aa, Homo sapiens
SYLDCIRAI

SEQ ID NO: 9313 - protein, 9 aa, Homo sapiens
WMDWLKQTY

SEQ ID NO: 9314 - protein, 9 aa, Homo sapiens
WMDWLKQTY

SEQ ID NO: 9315 - protein, 9 aa, Homo sapiens
RRFGRQRKI

SEQ ID NO: 9316 - protein, 9 aa, Homo sapiens
LPVTGASSA

SEQ ID NO: 9317 - protein, 9 aa, Homo sapiens
LPVTIPSSA

SEQ ID NO: 9318 - protein, 9 aa, Homo sapiens
IPSSASSGH

SEQ ID NO: 9319 - protein, 9 aa, Homo sapiens
LSTGHATPL

SEQ ID NO: 9320 - protein, 9 aa, Homo sapiens
LPVTSPSSV

SEQ ID NO: 9321 - protein, 9 aa, Homo sapiens
SPSSVSTGH

SEQ ID NO: 9322 - protein, 9 aa, Homo sapiens
APVADVIAE

SEQ ID NO: 9323 - protein, 9 aa, Homo sapiens
IAEDLVLSM

SEQ ID NO: 9324 - protein, 9 aa, Homo sapiens
THSHTHSHV

SEQ ID NO: 9325 - protein, 9 aa, Homo sapiens
THSHTHSHV

SEQ ID NO: 9326 - protein, 9 aa, Homo sapiens
DLRQDFNMM

SEQ ID NO: 9327 - protein, 9 aa, Homo sapiens
LLADLHPSV

SEQ ID NO: 9328 - protein, 9 aa, Homo sapiens
RRNARAKGM

SEQ ID NO: 9329 - protein, 9 aa, Homo sapiens
ETDIFELLK

SEQ ID NO: 9330 - protein, 9 aa, Homo sapiens
FRRGFQEAF

SEQ ID NO: 9331 - protein, 9 aa, Homo sapiens
FAPFLSRTL

SEQ ID NO: 9332 - protein, 9 aa, Homo sapiens
RIDLYARAL

SEQ ID NO: 9333 - protein, 9 aa, Homo sapiens
TAAKRIDLY

SEQ ID NO: 9334 - protein, 9 aa, Homo sapiens
EMIATEREY

SEQ ID NO: 9335 - protein, 9 aa, Homo sapiens
TEREYIRCL

SEQ ID NO: 9336 - protein, 9 aa, Homo sapiens
ARSIRIYEM

SEQ ID NO: 9337 - protein, 9 aa, Homo sapiens
YSILQGQPY

SEQ ID NO: 9338 - protein, 9 aa, Homo sapiens
YSILQGQPY

SEQ ID NO: 9339 - protein, 9 aa, Homo sapiens
GRLWHTSTV

SEQ ID NO: 9340 - protein, 9 aa, Homo sapiens
FRFDCGSGT

SEQ ID NO: 9341 - protein, 9 aa, Homo sapiens
ERSKRILPL

SEQ ID NO: 9342 - protein, 9 aa, Homo sapiens
ERSKRILPL

SEQ ID NO: 9343 - protein, 9 aa, Homo sapiens
PPAPPAPAF

SEQ ID NO: 9344 - protein, 9 aa, Homo sapiens
SPSAAAAAA

SEQ ID NO: 9345 - protein, 9 aa, Homo sapiens
SAAAAAAAA

SEQ ID NO: 9346 - protein, 9 aa, Homo sapiens
MCQVKNQPL

SEQ ID NO: 9347 - protein, 9 aa, Homo sapiens
PMMQKLIIL

SEQ ID NO: 9348 - protein, 9 aa, Homo sapiens
ERDPMMQKL

SEQ ID NO: 9349 - protein, 9 aa, Homo sapiens
AVAAKNVAL

SEQ ID NO: 9350 - protein, 9 aa, Homo sapiens
LPGPNASPF

SEQ ID NO: 9351 - protein, 9 aa, Homo sapiens
TRPEAEAAL

SEQ ID NO: 9352 - protein, 9 aa, Homo sapiens
DLDVDDVEM

SEQ ID NO: 9353 - protein, 9 aa, Homo sapiens
QITGSSWAF

SEQ ID NO: 9354 - protein, 9 aa, Homo sapiens
QLLSKVFSL

SEQ ID NO: 9355 - protein, 9 aa, Homo sapiens
VHSQLLSKV

SEQ ID NO: 9356 - protein, 9 aa, Homo sapiens
APRVKMYQL

SEQ ID NO: 9357 - protein, 9 aa, Homo sapiens
IPIKMVNFP

SEQ ID NO: 9358 - protein, 9 aa, Homo sapiens
RMAIKFKSF

SEQ ID NO: 9359 - protein, 9 aa, Homo sapiens
FPQKTIMPG

SEQ ID NO: 9360 - protein, 9 aa, Homo sapiens
MPGFKTTVY

SEQ ID NO: 9361 - protein, 9 aa, Homo sapiens
EHKPHIDKM

SEQ ID NO: 9362 - protein, 9 aa, Homo sapiens
FVAMKKYEL

SEQ ID NO: 9363 - protein, 9 aa, Homo sapiens
IPLKLEDAL

SEQ ID NO: 9364 - protein, 9 aa, Homo sapiens
LATENLQYM

SEQ ID NO: 9365 - protein, 9 aa, Homo sapiens
IKNDNLVYV

SEQ ID NO: 9366 - protein, 9 aa, Homo sapiens
CHSEEMWCT

SEQ ID NO: 9367 - protein, 9 aa, Homo sapiens
YPRPCQPCH

SEQ ID NO: 9368 - protein, 9 aa, Homo sapiens
VPMGPSGAL

SEQ ID NO: 9369 - protein, 9 aa, Homo sapiens
ALAPRGGSL

SEQ ID NO: 9370 - protein, 9 aa, Homo sapiens
LIMVQHWPE

SEQ ID NO: 9371 - protein, 9 aa, Homo sapiens
MVQHWPETV

SEQ ID NO: 9372 - protein, 9 aa, Homo sapiens
CQRGFCRLI

SEQ ID NO: 9373 - protein, 9 aa, Homo sapiens
EPNGIILGY

SEQ ID NO: 9374 - protein, 9 aa, Homo sapiens
LTSPLQLLA

SEQ ID NO: 9375 - protein, 9 aa, Homo sapiens
NAYALTSPL

SEQ ID NO: 9376 - protein, 9 aa, Homo sapiens
YALTSPLQL

SEQ ID NO: 9377 - protein, 9 aa, Homo sapiens
DVRPASTRF

SEQ ID NO: 9378 - protein, 9 aa, Homo sapiens
SSPKYPPLY

SEQ ID NO: 9379 - protein, 9 aa, Homo sapiens
SPLDSSPKY

SEQ ID NO: 9380 - protein, 9 aa, Homo sapiens
KRRQVKPLA

SEQ ID NO: 9381 - protein, 9 aa, Homo sapiens
ERLSYAFSV

SEQ ID NO: 9382 - protein, 9 aa, Homo sapiens
RERQRTQSL

SEQ ID NO: 9383 - protein, 9 aa, Homo sapiens
RERQRTQSL

SEQ ID NO: 9384 - protein, 9 aa, Homo sapiens
HSLGKEGPF

SEQ ID NO: 9385 - protein, 9 aa, Homo sapiens
SRQRATDEL

SEQ ID NO: 9386 - protein, 9 aa, Homo sapiens
RQRATDELF

SEQ ID NO: 9387 - protein, 9 aa, Homo sapiens
VRSETDASL

SEQ ID NO: 9388 - protein, 9 aa, Homo sapiens
NHFNYEKTH

SEQ ID NO: 9389 - protein, 9 aa, Homo sapiens
KTSFRLRSL

SEQ ID NO: 9390 - protein, 9 aa, Homo sapiens
SKGELSREI

SEQ ID NO: 9391 - protein, 9 aa, Homo sapiens
RAGNFDVAF

SEQ ID NO: 9392 - protein, 9 aa, Homo sapiens
SPACTELET

SEQ ID NO: 9393 - protein, 9 aa, Homo sapiens
SALTKHKRN

SEQ ID NO: 9394 - protein, 9 aa, Homo sapiens
RNHTGDRPY

SEQ ID NO: 9395 - protein, 9 aa, Homo sapiens
HTGDRPTSA

SEQ ID NO: 9396 - protein, 9 aa, Homo sapiens
IIHTRENSY

SEQ ID NO: 9397 - protein, 9 aa, Homo sapiens
YTGEKPYKY

SEQ ID NO: 9398 - protein, 9 aa, Homo sapiens
IIYTGEKPY

SEQ ID NO: 9399 - protein, 9 aa, Homo sapiens
IPFKRPCTY

SEQ ID NO: 9400 - protein, 9 aa, Homo sapiens
QVVDGSSSL

SEQ ID NO: 9401 - protein, 9 aa, Homo sapiens
MVNGKPKKV

SEQ ID NO: 9402 - protein, 9 aa, Homo sapiens
VVTEETFSF

SEQ ID NO: 9403 - protein, 9 aa, Homo sapiens
DRSKMSPDV

SEQ ID NO: 9404 - protein, 9 aa, Homo sapiens
FHRGGVARL

SEQ ID NO: 9405 - protein, 9 aa, Homo sapiens
HRGGVARLL

SEQ ID NO: 9406 - protein, 9 aa, Homo sapiens
RRFQLYRSM

SEQ ID NO: 9407 - protein, 9 aa, Homo sapiens
RRFQLYRSM

SEQ ID NO: 9408 - protein, 9 aa, Homo sapiens
LLRKRRFQL

SEQ ID NO: 9409 - protein, 9 aa, Homo sapiens
ALRARRKEV

SEQ ID NO: 9410 - protein, 9 aa, Homo sapiens
LRARRKEVF

SEQ ID NO: 9411 - protein, 9 aa, Homo sapiens
YREDRPSLP

SEQ ID NO: 9412 - protein, 9 aa, Homo sapiens
RRSPRNLIY

SEQ ID NO: 9413 - protein, 9 aa, Homo sapiens
SARATGTAF

SEQ ID NO: 9414 - protein, 9 aa, Homo sapiens
FRRSPRNLI

SEQ ID NO: 9415 - protein, 9 aa, Homo sapiens
LAGGSLHDY

SEQ ID NO: 9416 - protein, 9 aa, Homo sapiens
LAGGSLHDY

SEQ ID NO: 9417 - protein, 9 aa, Homo sapiens
FKREWASVM

SEQ ID NO: 9418 - protein, 9 aa, Homo sapiens
YSCNPGYAM

SEQ ID NO: 9419 - protein, 9 aa, Homo sapiens
GPIWLNEVF

SEQ ID NO: 9420 - protein, 9 aa, Homo sapiens
SSTSSILPF

SEQ ID NO: 9421 - protein, 9 aa, Homo sapiens
TYHDQLVEL

SEQ ID NO: 9422 - protein, 9 aa, Homo sapiens
YHDQLVELL

SEQ ID NO: 9423 - protein, 9 aa, Homo sapiens
HKGRKRMHL

SEQ ID NO: 9424 - protein, 9 aa, Homo sapiens
GRKRMHLEL

SEQ ID NO: 9425 - protein, 9 aa, Homo sapiens
PHHKGRKRM

SEQ ID NO: 9426 - protein, 9 aa, Homo sapiens
GRKRMHLEL

SEQ ID NO: 9427 - protein, 9 aa, Homo sapiens
LALNFSVFY

SEQ ID NO: 9428 - protein, 9 aa, Homo sapiens
IRLGLALNF

SEQ ID NO: 9429 - protein, 9 aa, Homo sapiens
VSAGGVPPM

SEQ ID NO: 9430 - protein, 9 aa, Homo sapiens
FTYGTVVFY

SEQ ID NO: 9431 - protein, 9 aa, Homo sapiens
FTYGTVVFY

SEQ ID NO: 9432 - protein, 9 aa, Homo sapiens
FTYGTVVFY

SEQ ID NO: 9433 - protein, 9 aa, Homo sapiens
HPLPRCEAL

SEQ ID NO: 9434 - protein, 9 aa, Homo sapiens
LPRCEALCG

SEQ ID NO: 9435 - protein, 9 aa, Homo sapiens
LVASPQDRY

SEQ ID NO: 9436 - protein, 9 aa, Homo sapiens
SPQDRYVPF

SEQ ID NO: 9437 - protein, 9 aa, Homo sapiens
TVHSRVFQI

SEQ ID NO: 9438 - protein, 9 aa, Homo sapiens
VHSRVFQIL

SEQ ID NO: 9439 - protein, 9 aa, Homo sapiens
EPENAVTIT

SEQ ID NO: 9440 - protein, 9 aa, Homo sapiens
TPLRPEDDY

SEQ ID NO: 9441 - protein, 9 aa, Homo sapiens
MPREDAHFI

SEQ ID NO: 9442 - protein, 9 aa, Homo sapiens
IATWGIVVM

SEQ ID NO: 9443 - protein, 9 aa, Homo sapiens
GHRDVARYL

SEQ ID NO: 9444 - protein, 9 aa, Homo sapiens
QPDSPSAQL

SEQ ID NO: 9445 - protein, 9 aa, Homo sapiens
YFDGHVWPM

SEQ ID NO: 9446 - protein, 9 aa, Homo sapiens
CPRQELKTL

SEQ ID NO: 9447 - protein, 9 aa, Homo sapiens
VPLAHWACL

SEQ ID NO: 9448 - protein, 9 aa, Homo sapiens
VPLAHWACL

SEQ ID NO: 9449 - protein, 9 aa, Homo sapiens
KTDCPELAV

SEQ ID NO: 9450 - protein, 9 aa, Homo sapiens
LYYQINATS

SEQ ID NO: 9451 - protein, 9 aa, Homo sapiens
SPWVRDLCG

SEQ ID NO: 9452 - protein, 9 aa, Homo sapiens
ATSPWVRDL

SEQ ID NO: 9453 - protein, 9 aa, Homo sapiens
SLKYLDLSF

SEQ ID NO: 9454 - protein, 9 aa, Homo sapiens
LSFNGVITM

SEQ ID NO: 9455 - protein, 9 aa, Homo sapiens
WRRLRKALL

SEQ ID NO: 9456 - protein, 9 aa, Homo sapiens
IANVERVPF

SEQ ID NO: 9457 - protein, 9 aa, Homo sapiens
ERVPFDAAT

SEQ ID NO: 9458 - protein, 9 aa, Homo sapiens
SHIANVERV

SEQ ID NO: 9459 - protein, 9 aa, Homo sapiens
YPAHFNHAD

SEQ ID NO: 9460 - protein, 9 aa, Homo sapiens
KMREKGIKL

SEQ ID NO: 9461 - protein, 9 aa, Homo sapiens
MREKGIKLL

SEQ ID NO: 9462 - protein, 9 aa, Homo sapiens
TRSQRARGV

SEQ ID NO: 9463 - protein, 9 aa, Homo sapiens
QRARGVPHL

SEQ ID NO: 9464 - protein, 9 aa, Homo sapiens
FLDAHGAWL

SEQ ID NO: 9465 - protein, 9 aa, Homo sapiens
AHGAWLPEL

SEQ ID NO: 9466 - protein, 9 aa, Homo sapiens
VRIPKEQGV

SEQ ID NO: 9467 - protein, 9 aa, Homo sapiens
RASAHGTEL

SEQ ID NO: 9468 - protein, 9 aa, Homo sapiens
FLHLWWTVY

SEQ ID NO: 9469 - protein, 9 aa, Homo sapiens
APGAFSSQY

SEQ ID NO: 9470 - protein, 9 aa, Homo sapiens
EPHPYLPVL

SEQ ID NO: 9471 - protein, 9 aa, Homo sapiens
WLDLRTQST

SEQ ID NO: 9472 - protein, 9 aa, Homo sapiens
LTDWLSLLD

SEQ ID NO: 9473 - protein, 9 aa, Homo sapiens
EAVLQSPEF

SEQ ID NO: 9474 - protein, 9 aa, Homo sapiens
PPKTRVSHL

SEQ ID NO: 9475 - protein, 9 aa, Homo sapiens
SAFSRASVI

SEQ ID NO: 9476 - protein, 9 aa, Homo sapiens
SAFSRASVI

SEQ ID NO: 9477 - protein, 9 aa, Homo sapiens
THTGEKPFV

SEQ ID NO: 9478 - protein, 9 aa, Homo sapiens
ARAEARTRM

SEQ ID NO: 9479 - protein, 9 aa, Homo sapiens
MAAACRSVK

SEQ ID NO: 9480 - protein, 9 aa, Homo sapiens
VPSAPHFVH

SEQ ID NO: 9481 - protein, 9 aa, Homo sapiens
SRITMNPKV

SEQ ID NO: 9482 - protein, 9 aa, Homo sapiens
HQMTPSSSY

SEQ ID NO: 9483 - protein, 9 aa, Homo sapiens
CIKDYMKSI

SEQ ID NO: 9484 - protein, 9 aa, Homo sapiens
TMVCRLDSA

SEQ ID NO: 9485 - protein, 9 aa, Homo sapiens
PMNNLESFY

SEQ ID NO: 9486 - protein, 9 aa, Homo sapiens
FPGGRPPRA

SEQ ID NO: 9487 - protein, 9 aa, Homo sapiens
EAANFDLAV

SEQ ID NO: 9488 - protein, 9 aa, Homo sapiens
WMKMYSDAF

SEQ ID NO: 9489 - protein, 9 aa, Homo sapiens
WMKMYSDAF

SEQ ID NO: 9490 - protein, 9 aa, Homo sapiens
DRHGHKDWI

SEQ ID NO: 9491 - protein, 9 aa, Homo sapiens
GHKDWIFAV

SEQ ID NO: 9492 - protein, 9 aa, Homo sapiens
GSRKRKAPA

SEQ ID NO: 9493 - protein, 9 aa, Homo sapiens
SRKRKAPAV

SEQ ID NO: 9494 - protein, 9 aa, Homo sapiens
SRKRKAPAV

SEQ ID NO: 9495 - protein, 9 aa, Homo sapiens
FLEDGTSQV

SEQ ID NO: 9496 - protein, 9 aa, Homo sapiens
SAFHENTTY

SEQ ID NO: 9497 - protein, 9 aa, Homo sapiens
SPKTMKKFL

SEQ ID NO: 9498 - protein, 9 aa, Homo sapiens
SRVPGHSSL

SEQ ID NO: 9499 - protein, 9 aa, Homo sapiens
SPLQFYVDY

SEQ ID NO: 9500 - protein, 9 aa, Homo sapiens
LFGKKSSPL

SEQ ID NO: 9501 - protein, 9 aa, Homo sapiens
ELRRQMKML

SEQ ID NO: 9502 - protein, 9 aa, Homo sapiens
RLVDKDCVL

SEQ ID NO: 9503 - protein, 9 aa, Homo sapiens
SDLMRDRSA

SEQ ID NO: 9504 - protein, 9 aa, Homo sapiens
DLMRDRSAA

SEQ ID NO: 9505 - protein, 9 aa, Homo sapiens
NPRSLENSL

SEQ ID NO: 9506 - protein, 9 aa, Homo sapiens
FLWTTDMAA

SEQ ID NO: 9507 - protein, 9 aa, Homo sapiens
HIILHYCAF

SEQ ID NO: 9508 - protein, 9 aa, Homo sapiens
HIILHYCAF

SEQ ID NO: 9509 - protein, 9 aa, Homo sapiens
HYCAFKTTW

SEQ ID NO: 9510 - protein, 9 aa, Homo sapiens
IHPDGEKVA

SEQ ID NO: 9511 - protein, 9 aa, Homo sapiens
MRGEYDALL

SEQ ID NO: 9512 - protein, 9 aa, Homo sapiens
AKFQHQVEM

SEQ ID NO: 9513 - protein, 9 aa, Homo sapiens
TSDMWLYRA

SEQ ID NO: 9514 - protein, 9 aa, Homo sapiens
LYRAYSGNL

SEQ ID NO: 9515 - protein, 9 aa, Homo sapiens
EDIARRKAL

SEQ ID NO: 9516 - protein, 9 aa, Homo sapiens
RWMKHEPGL

SEQ ID NO: 9517 - protein, 9 aa, Homo sapiens
IREQHCLFR

SEQ ID NO: 9518 - protein, 9 aa, Homo sapiens
KCYDCGKSF

SEQ ID NO: 9519 - protein, 9 aa, Homo sapiens
SESSRGPSL

SEQ ID NO: 9520 - protein, 9 aa, Homo sapiens
RRHIYDTKL

SEQ ID NO: 9521 - protein, 9 aa, Homo sapiens
RRHIYDTKL

SEQ ID NO: 9522 - protein, 9 aa, Homo sapiens
KKGENSVSV

SEQ ID NO: 9523 - protein, 9 aa, Homo sapiens
RKYGEQKTL

SEQ ID NO: 9524 - protein, 9 aa, Homo sapiens
RKYGEQKTL

SEQ ID NO: 9525 - protein, 9 aa, Homo sapiens
KYGEQKTLF

SEQ ID NO: 9526 - protein, 9 aa, Homo sapiens
SAKMRRYDR

SEQ ID NO: 9527 - protein, 9 aa, Homo sapiens
KMRRYDRGL

SEQ ID NO: 9528 - protein, 9 aa, Homo sapiens
RRYDRGLKT

SEQ ID NO: 9529 - protein, 9 aa, Homo sapiens
KGFKCPSTL

SEQ ID NO: 9530 - protein, 9 aa, Homo sapiens
EAFKYSSSL

SEQ ID NO: 9531 - protein, 9 aa, Homo sapiens
EAFKYSSSL

SEQ ID NO: 9532 - protein, 9 aa, Homo sapiens
KAFNQSSIL

SEQ ID NO: 9533 - protein, 9 aa, Homo sapiens
SHLTTHKMI

SEQ ID NO: 9534 - protein, 9 aa, Homo sapiens
TRHKRIHTE

SEQ ID NO: 9535 - protein, 9 aa, Homo sapiens
SHLAQHKKI

SEQ ID NO: 9536 - protein, 9 aa, Homo sapiens
TLEPDSLPF

SEQ ID NO: 9537 - protein, 9 aa, Homo sapiens
FASPAGLEP

SEQ ID NO: 9538 - protein, 9 aa, Homo sapiens
SPAGLEPGL

SEQ ID NO: 9539 - protein, 9 aa, Homo sapiens
FASPAGLEP

SEQ ID NO: 9540 - protein, 9 aa, Homo sapiens
YVMTREQHV

SEQ ID NO: 9541 - protein, 9 aa, Homo sapiens
YKCNECSKV

SEQ ID NO: 9542 - protein, 9 aa, Homo sapiens
RLRHHVLSL

SEQ ID NO: 9543 - protein, 9 aa, Homo sapiens
RHHVLSLAL

SEQ ID NO: 9544 - protein, 9 aa, Homo sapiens
QFRYKLQDF

SEQ ID NO: 9545 - protein, 9 aa, Homo sapiens
IISDYHQQF

SEQ ID NO: 9546 - protein, 9 aa, Homo sapiens
YHQQFRYKL

SEQ ID NO: 9547 - protein, 9 aa, Homo sapiens
YHQQFRYKL

SEQ ID NO: 9548 - protein, 9 aa, Homo sapiens
ALFTRHKPL

SEQ ID NO: 9549 - protein, 9 aa, Homo sapiens
ALFTRHKPL

SEQ ID NO: 9550 - protein, 9 aa, Homo sapiens
RPPPPPPAS

SEQ ID NO: 9551 - protein, 9 aa, Homo sapiens
AAAAQPSPL

SEQ ID NO: 9552 - protein, 9 aa, Homo sapiens
RARRFLARL

SEQ ID NO: 9553 - protein, 9 aa, Homo sapiens
QRARRFLAR

SEQ ID NO: 9554 - protein, 9 aa, Homo sapiens
RARRFLARL

SEQ ID NO: 9555 - protein, 9 aa, Homo sapiens
SPWTPSLLI

SEQ ID NO: 9556 - protein, 9 aa, Homo sapiens
SPWTLSLTL

SEQ ID NO: 9557 - protein, 9 aa, Homo sapiens
HSSPWTLSL

SEQ ID NO: 9558 - protein, 9 aa, Homo sapiens
YPHSSPWTL

SEQ ID NO: 9559 - protein, 9 aa, Homo sapiens
WPGNAWRAA

SEQ ID NO: 9560 - protein, 9 aa, Homo sapiens
RPMQQARAQ

SEQ ID NO: 9561 - protein, 9 aa, Homo sapiens
NIWSQVRPM

SEQ ID NO: 9562 - protein, 9 aa, Homo sapiens
EISLRLHRL

SEQ ID NO: 9563 - protein, 9 aa, Homo sapiens
PPETEIVPL

SEQ ID NO: 9564 - protein, 9 aa, Homo sapiens
EPEPGEPLL

SEQ ID NO: 9565 - protein, 9 aa, Homo sapiens
NSAAALGVY

SEQ ID NO: 9566 - protein, 9 aa, Homo sapiens
EALVRVLVL

SEQ ID NO: 9567 - protein, 9 aa, Homo sapiens
PPAAPLSEL

SEQ ID NO: 9568 - protein, 9 aa, Homo sapiens
HTGERPYPC

SEQ ID NO: 9569 - protein, 9 aa, Homo sapiens
STLTRHKIV

SEQ ID NO: 9570 - protein, 9 aa, Homo sapiens
APASKTLTL

SEQ ID NO: 9571 - protein, 9 aa, Homo sapiens
APASKTLTL

SEQ ID NO: 9572 - protein, 9 aa, Homo sapiens
QRAPASKTL

SEQ ID NO: 9573 - protein, 9 aa, Homo sapiens
GPRPAREAS

SEQ ID NO: 9574 - protein, 9 aa, Homo sapiens
EVIDRLRYL

SEQ ID NO: 9575 - protein, 9 aa, Homo sapiens
YLKAEIEDL

SEQ ID NO: 9576 - protein, 9 aa, Homo sapiens
HLLPPTLPT

SEQ ID NO: 9577 - protein, 9 aa, Homo sapiens
RRRGCVHLR

SEQ ID NO: 9578 - protein, 9 aa, Homo sapiens
RPSKRRMQA

SEQ ID NO: 9579 - protein, 9 aa, Homo sapiens
RPSKRRMQA

SEQ ID NO: 9580 - protein, 9 aa, Homo sapiens
SQLQRLREL

SEQ ID NO: 9581 - protein, 9 aa, Homo sapiens
KGKKLPANI

SEQ ID NO: 9582 - protein, 9 aa, Homo sapiens
DTHYWAGWY

SEQ ID NO: 9583 - protein, 9 aa, Homo sapiens
WAGWYGPRV

SEQ ID NO: 9584 - protein, 9 aa, Homo sapiens
ILVSYIRII

SEQ ID NO: 9585 - protein, 9 aa, Homo sapiens
PMYLFLSFL

SEQ ID NO: 9586 - protein, 9 aa, Homo sapiens
YLFLSFLSF

SEQ ID NO: 9587 - protein, 9 aa, Homo sapiens
PLFPPKVDL

SEQ ID NO: 9588 - protein, 9 aa, Homo sapiens
APYCGDGKV

SEQ ID NO: 9589 - protein, 9 aa, Homo sapiens
FPDWERTKL

SEQ ID NO: 9590 - protein, 9 aa, Homo sapiens
FPDWERTKL

SEQ ID NO: 9591 - protein, 9 aa, Homo sapiens
TYPEGTQAI

SEQ ID NO: 9592 - protein, 9 aa, Homo sapiens
YPEGTQAIY

SEQ ID NO: 9593 - protein, 9 aa, Homo sapiens
VQPMALLLF

SEQ ID NO: 9594 - protein, 9 aa, Homo sapiens
QRSFHNFTL

SEQ ID NO: 9595 - protein, 9 aa, Homo sapiens
FHNFTLCYI

SEQ ID NO: 9596 - protein, 9 aa, Homo sapiens
RYERELKKL

SEQ ID NO: 9597 - protein, 9 aa, Homo sapiens
LFHDDIHHV

SEQ ID NO: 9598 - protein, 9 aa, Homo sapiens
YTVVAFNFF

SEQ ID NO: 9599 - protein, 9 aa, Homo sapiens
VAFNFFRKF

SEQ ID NO: 9600 - protein, 9 aa, Homo sapiens
FVQRAMDYF

SEQ ID NO: 9601 - protein, 9 aa, Homo sapiens
RAMDYFPKI

SEQ ID NO: 9602 - protein, 9 aa, Homo sapiens
CASNIIHHF

SEQ ID NO: 9603 - protein, 9 aa, Homo sapiens
FCASNIIHH

SEQ ID NO: 9604 - protein, 9 aa, Homo sapiens
VFYTILTPM

SEQ ID NO: 9605 - protein, 9 aa, Homo sapiens
KVVSAFYTI

SEQ ID NO: 9606 - protein, 9 aa, Homo sapiens
KVVSAFYTI

SEQ ID NO: 9607 - protein, 9 aa, Homo sapiens
VVSAFYTIV

SEQ ID NO: 9608 - protein, 9 aa, Homo sapiens
MAAMFGGSF

SEQ ID NO: 9609 - protein, 9 aa, Homo sapiens
MAAMFGGSF

SEQ ID NO: 9610 - protein, 9 aa, Homo sapiens
AAMFGGSFV

SEQ ID NO: 9611 - protein, 9 aa, Homo sapiens
LYLAKQVFV

SEQ ID NO: 9612 - protein, 9 aa, Homo sapiens
QVFVGFLLI

SEQ ID NO: 9613 - protein, 9 aa, Homo sapiens
ATRELGVKI

SEQ ID NO: 9614 - protein, 9 aa, Homo sapiens
LGVKIAKAV

SEQ ID NO: 9615 - protein, 9 aa, Homo sapiens
IMDDLTEVL

SEQ ID NO: 9616 - protein, 9 aa, Homo sapiens
LFPPFVNPI

SEQ ID NO: 9617 - protein, 9 aa, Homo sapiens
FPPFVNPII

SEQ ID NO: 9618 - protein, 9 aa, Homo sapiens
FVNPIIYSI

SEQ ID NO: 9619 - protein, 9 aa, Homo sapiens
VATTGDITV

SEQ ID NO: 9620 - protein, 9 aa, Homo sapiens
TTGDITVSV

SEQ ID NO: 9621 - protein, 9 aa, Homo sapiens
LIATGMFQF

SEQ ID NO: 9622 - protein, 9 aa, Homo sapiens
MFQFWPHSI

SEQ ID NO: 9623 - protein, 9 aa, Homo sapiens
MFQFWPHSI

SEQ ID NO: 9624 - protein, 9 aa, Homo sapiens
IYTIPNCSF

SEQ ID NO: 9625 - protein, 9 aa, Homo sapiens
KPLHYMTIM

SEQ ID NO: 9626 - protein, 9 aa, Homo sapiens
FHPHGVLAV

SEQ ID NO: 9627 - protein, 9 aa, Homo sapiens
LAVGAFANL

SEQ ID NO: 9628 - protein, 9 aa, Homo sapiens
DYADLPEYF

SEQ ID NO: 9629 - protein, 9 aa, Homo sapiens
SPYEQSEIL

SEQ ID NO: 9630 - protein, 9 aa, Homo sapiens
LVEDLKNKY

SEQ ID NO: 9631 - protein, 9 aa, Homo sapiens
RYVNLTSLL

SEQ ID NO: 9632 - protein, 9 aa, Homo sapiens
MRYVNLTSL

SEQ ID NO: 9633 - protein, 9 aa, Homo sapiens
YVNLTSLLI

SEQ ID NO: 9634 - protein, 9 aa, Homo sapiens
VYVPSASLF

SEQ ID NO: 9635 - protein, 9 aa, Homo sapiens
LAGQPLVYV

SEQ ID NO: 9636 - protein, 9 aa, Homo sapiens
LVYVPSASL

SEQ ID NO: 9637 - protein, 9 aa, Homo sapiens
DHMISDGFL

SEQ ID NO: 9638 - protein, 9 aa, Homo sapiens
MISDGFLTI

SEQ ID NO: 9639 - protein, 9 aa, Homo sapiens
NQFESLKQL

SEQ ID NO: 9640 - protein, 9 aa, Homo sapiens
LMGKGMKRV

SEQ ID NO: 9641 - protein, 9 aa, Homo sapiens
TYNPVWQNR

SEQ ID NO: 9642 - protein, 9 aa, Homo sapiens
DTYNPVWQN

SEQ ID NO: 9643 - protein, 9 aa, Homo sapiens
LLYMKEKPL

SEQ ID NO: 9644 - protein, 9 aa, Homo sapiens
YMKEKPLTY

SEQ ID NO: 9645 - protein, 9 aa, Homo sapiens
LTYEHGVKL

SEQ ID NO: 9646 - protein, 9 aa, Homo sapiens
VAVPAAAPV

SEQ ID NO: 9647 - protein, 9 aa, Homo sapiens
NPMHRLLNP

SEQ ID NO: 9648 - protein, 9 aa, Homo sapiens
EVMAPDVEV

SEQ ID NO: 9649 - protein, 9 aa, Homo sapiens
MAPDVEVSL

SEQ ID NO: 9650 - protein, 9 aa, Homo sapiens
MAPDVEVSL

SEQ ID NO: 9651 - protein, 9 aa, Homo sapiens
VALDFENEM

SEQ ID NO: 9652 - protein, 9 aa, Homo sapiens
KNLPPVLLV

SEQ ID NO: 9653 - protein, 9 aa, Homo sapiens
VLLADILPT

SEQ ID NO: 9654 - protein, 9 aa, Homo sapiens
LADILPTLV

SEQ ID NO: 9655 - protein, 9 aa, Homo sapiens
MAGSGRLVL

SEQ ID NO: 9656 - protein, 9 aa, Homo sapiens
IYQFLQSRF

SEQ ID NO: 9657 - protein, 9 aa, Homo sapiens
FLQSRFPFF

SEQ ID NO: 9658 - protein, 9 aa, Homo sapiens
SLKDAVITV

SEQ ID NO: 9659 - protein, 9 aa, Homo sapiens
MMVPIAHAV

SEQ ID NO: 9660 - protein, 9 aa, Homo sapiens
IAHAVLDQL

SEQ ID NO: 9661 - protein, 9 aa, Homo sapiens
VAVLQLDEV

SEQ ID NO: 9662 - protein, 9 aa, Homo sapiens
LQLDEVNLY

SEQ ID NO: 9663 - protein, 9 aa, Homo sapiens
FQNNGVALL

SEQ ID NO: 9664 - protein, 9 aa, Homo sapiens
NLVNVMNGY

SEQ ID NO: 9665 - protein, 9 aa, Homo sapiens
VLDNLVNVM

SEQ ID NO: 9666 - protein, 9 aa, Homo sapiens
YQRQRPSEI

SEQ ID NO: 9667 - protein, 9 aa, Homo sapiens
YQRQRPSEI

SEQ ID NO: 9668 - protein, 9 aa, Homo sapiens
SFSGLMPTF

SEQ ID NO: 9669 - protein, 9 aa, Homo sapiens
MMYGDNSFS

SEQ ID NO: 9670 - protein, 9 aa, Homo sapiens
FPDEPMREY

SEQ ID NO: 9671 - protein, 9 aa, Homo sapiens
TAHQTSAQS

SEQ ID NO: 9672 - protein, 9 aa, Homo sapiens
TSAQSPNLV

SEQ ID NO: 9673 - protein, 9 aa, Homo sapiens
IFLCSFLML

SEQ ID NO: 9674 - protein, 9 aa, Homo sapiens
LMLNLFVAV

SEQ ID NO: 9675 - protein, 9 aa, Homo sapiens
MLNLFVAVI

SEQ ID NO: 9676 - protein, 9 aa, Homo sapiens
KSFCMLSQL

SEQ ID NO: 9677 - protein, 9 aa, Homo sapiens
KAFSQSSTL

SEQ ID NO: 9678 - protein, 9 aa, Homo sapiens
YSETPKPSI

SEQ ID NO: 9679 - protein, 9 aa, Homo sapiens
ETCARILLY

SEQ ID NO: 9680 - protein, 9 aa, Homo sapiens
YNKETCARI

SEQ ID NO: 9681 - protein, 9 aa, Homo sapiens
LWLGPAAFI

SEQ ID NO: 9682 - protein, 9 aa, Homo sapiens
KSFHRSSSL

SEQ ID NO: 9683 - protein, 9 aa, Homo sapiens
RAIPDTRHL

SEQ ID NO: 9684 - protein, 9 aa, Homo sapiens
DTRHLRCTL

SEQ ID NO: 9685 - protein, 9 aa, Homo sapiens
ASFDATTCI

SEQ ID NO: 9686 - protein, 9 aa, Homo sapiens
FGFSFNAPL

SEQ ID NO: 9687 - protein, 9 aa, Homo sapiens
ETFNTPAMY

SEQ ID NO: 9688 - protein, 9 aa, Homo sapiens
IMFETFNTP

SEQ ID NO: 9689 - protein, 9 aa, Homo sapiens
ETFNTPAMY

SEQ ID NO: 9690 - protein, 9 aa, Homo sapiens
NTPAMYVAI

SEQ ID NO: 9691 - protein, 9 aa, Homo sapiens
YYNRLINGL

SEQ ID NO: 9692 - protein, 9 aa, Homo sapiens
MAHQKPTPA

SEQ ID NO: 9693 - protein, 9 aa, Homo sapiens
PALEKVVPL

SEQ ID NO: 9694 - protein, 9 aa, Homo sapiens
ETFGNSMIC

SEQ ID NO: 9695 - protein, 9 aa, Homo sapiens
CLFQITTSA

SEQ ID NO: 9696 - protein, 9 aa, Homo sapiens
RMKDKRQRL

SEQ ID NO: 9697 - protein, 9 aa, Homo sapiens
QARHTGIKI

SEQ ID NO: 9698 - protein, 9 aa, Homo sapiens
HGFSPRDIT

SEQ ID NO: 9699 - protein, 9 aa, Homo sapiens
FVTDGPGNY

SEQ ID NO: 9700 - protein, 9 aa, Homo sapiens
TYSDSSSMF

SEQ ID NO: 9701 - protein, 9 aa, Homo sapiens
NTYSDSSSM

SEQ ID NO: 9702 - protein, 9 aa, Homo sapiens
ETAVIVETM

SEQ ID NO: 9703 - protein, 9 aa, Homo sapiens
QTYEETAVI

SEQ ID NO: 9704 - protein, 9 aa, Homo sapiens
TAVIVETMI

SEQ ID NO: 9705 - protein, 9 aa, Homo sapiens
NTAKNKWFV

SEQ ID NO: 9706 - protein, 9 aa, Homo sapiens
HTVQHLEEV

SEQ ID NO: 9707 - protein, 9 aa, Homo sapiens
HTVQHLEEV

SEQ ID NO: 9708 - protein, 9 aa, Homo sapiens
RSDVHTEAV

SEQ ID NO: 9709 - protein, 9 aa, Homo sapiens
VTQLPISPL

SEQ ID NO: 9710 - protein, 9 aa, Homo sapiens
QHSTIVLTL

SEQ ID NO: 9711 - protein, 9 aa, Homo sapiens
YSQHSTIVL

SEQ ID NO: 9712 - protein, 9 aa, Homo sapiens
YQVVQEGHL

SEQ ID NO: 9713 - protein, 9 aa, Homo sapiens
HPKEYVTLV

SEQ ID NO: 9714 - protein, 9 aa, Homo sapiens
KYCAVYYII

SEQ ID NO: 9715 - protein, 9 aa, Homo sapiens
YYIIQIHFV

SEQ ID NO: 9716 - protein, 9 aa, Homo sapiens
WKYCAVYYI

SEQ ID NO: 9717 - protein, 9 aa, Homo sapiens
CAVYYIIQI

SEQ ID NO: 9718 - protein, 9 aa, Homo sapiens
RSFLGYASF

SEQ ID NO: 9719 - protein, 9 aa, Homo sapiens
FVIDGDSLL

SEQ ID NO: 9720 - protein, 9 aa, Homo sapiens
FVIDGDSLL

SEQ ID NO: 9721 - protein, 9 aa, Homo sapiens
VIDGDSLLV

SEQ ID NO: 9722 - protein, 9 aa, Homo sapiens
FLFRKLASG

SEQ ID NO: 9723 - protein, 9 aa, Homo sapiens
LASGFGEDV

SEQ ID NO: 9724 - protein, 9 aa, Homo sapiens
CACERDGRV

SEQ ID NO: 9725 - protein, 9 aa, Homo sapiens
LARGKRWIL

SEQ ID NO: 9726 - protein, 9 aa, Homo sapiens
GIGGAIPTV

SEQ ID NO: 9727 - protein, 9 aa, Homo sapiens
QPAAGGARI

SEQ ID NO: 9728 - protein, 9 aa, Homo sapiens
ENADNGTTV

SEQ ID NO: 9729 - protein, 9 aa, Homo sapiens
NADNGTTVI

SEQ ID NO: 9730 - protein, 9 aa, Homo sapiens
GAGSAGGTV

SEQ ID NO: 9731 - protein, 9 aa, Homo sapiens
LSATVTLTV

SEQ ID NO: 9732 - protein, 9 aa, Homo sapiens
RSPPFNLQI

SEQ ID NO: 9733 - protein, 9 aa, Homo sapiens
LQFRPDLRL

SEQ ID NO: 9734 - protein, 9 aa, Homo sapiens
FVHNNSKHG

SEQ ID NO: 9735 - protein, 9 aa, Homo sapiens
TAKKDGTHV

SEQ ID NO: 9736 - protein, 9 aa, Homo sapiens
RVGPVSAIG

SEQ ID NO: 9737 - protein, 9 aa, Homo sapiens
PAKAVGEHL

SEQ ID NO: 9738 - protein, 9 aa, Homo sapiens
FFFLASFCW

SEQ ID NO: 9739 - protein, 9 aa, Homo sapiens
LHFFFLASF

SEQ ID NO: 9740 - protein, 9 aa, Homo sapiens
TAVGVLLGL

SEQ ID NO: 9741 - protein, 9 aa, Homo sapiens
CRKRKLDII

SEQ ID NO: 9742 - protein, 9 aa, Homo sapiens
LSSAGTAGV

SEQ ID NO: 9743 - protein, 9 aa, Homo sapiens
SAGTAGVLI

SEQ ID NO: 9744 - protein, 9 aa, Homo sapiens
IYFRKGPFF

SEQ ID NO: 9745 - protein, 9 aa, Homo sapiens
IYFRKGPFF

SEQ ID NO: 9746 - protein, 9 aa, Homo sapiens
NPNVNAGII

SEQ ID NO: 9747 - protein, 9 aa, Homo sapiens
WFQNARAKE

SEQ ID NO: 9748 - protein, 9 aa, Homo sapiens
NARAKEKKF

SEQ ID NO: 9749 - protein, 9 aa, Homo sapiens
RAKEKKFKI

SEQ ID NO: 9750 - protein, 9 aa, Homo sapiens
FDSDEPWTL

SEQ ID NO: 9751 - protein, 9 aa, Homo sapiens
THFDSDEPW

SEQ ID NO: 9752 - protein, 9 aa, Homo sapiens
FDSDEPWTL

SEQ ID NO: 9753 - protein, 9 aa, Homo sapiens
YKNNPNFSI

SEQ ID NO: 9754 - protein, 9 aa, Homo sapiens
LSSDGQNVV

SEQ ID NO: 9755 - protein, 9 aa, Homo sapiens
FSRHKKRLL

SEQ ID NO: 9756 - protein, 9 aa, Homo sapiens
NYRTSGMQF

SEQ ID NO: 9757 - protein, 9 aa, Homo sapiens
RALALDCEM

SEQ ID NO: 9758 - protein, 9 aa, Homo sapiens
LALDCEMVG

SEQ ID NO: 9759 - protein, 9 aa, Homo sapiens
LMLKDYTKV

SEQ ID NO: 9760 - protein, 9 aa, Homo sapiens
MGVDGVSAY

SEQ ID NO: 9761 - protein, 9 aa, Homo sapiens
MGVDGVSAY

SEQ ID NO: 9762 - protein, 9 aa, Homo sapiens
GVDGVSAYL

SEQ ID NO: 9763 - protein, 9 aa, Homo sapiens
LSFSYGDIL

SEQ ID NO: 9764 - protein, 9 aa, Homo sapiens
FSYGDILHV

SEQ ID NO: 9765 - protein, 9 aa, Homo sapiens
NPRDYSTEL

SEQ ID NO: 9766 - protein, 9 aa, Homo sapiens
MYASIYFLV

SEQ ID NO: 9767 - protein, 9 aa, Homo sapiens
IYFLVCISV

SEQ ID NO: 9768 - protein, 9 aa, Homo sapiens
FPLYGQGEL

SEQ ID NO: 9769 - protein, 9 aa, Homo sapiens
YAHIRPRDV

SEQ ID NO: 9770 - protein, 9 aa, Homo sapiens
FEQDFQQLV

SEQ ID NO: 9771 - protein, 9 aa, Homo sapiens
KAEMLERVI

SEQ ID NO: 9772 - protein, 9 aa, Homo sapiens
MQKAEEKEV

SEQ ID NO: 9773 - protein, 9 aa, Homo sapiens
HPGSSRGGR

SEQ ID NO: 9774 - protein, 9 aa, Homo sapiens
KTAAINADE

SEQ ID NO: 9775 - protein, 9 aa, Homo sapiens
FSVVITGLR

SEQ ID NO: 9776 - protein, 9 aa, Homo sapiens
QMDNLESRV

SEQ ID NO: 9777 - protein, 9 aa, Homo sapiens
AGDGTHRFF

SEQ ID NO: 9778 - protein, 9 aa, Homo sapiens
RSSKDLRAR

SEQ ID NO: 9779 - protein, 9 aa, Homo sapiens
WEKSALLKH

SEQ ID NO: 9780 - protein, 9 aa, Homo sapiens
TEEEIRPSL

SEQ ID NO: 9781 - protein, 9 aa, Homo sapiens
RSKQILSTT

SEQ ID NO: 9782 - protein, 9 aa, Homo sapiens
QILSTTTVR

SEQ ID NO: 9783 - protein, 9 aa, Homo sapiens
IQSFKAEFR

SEQ ID NO: 9784 - protein, 9 aa, Homo sapiens
RQYDEFYLA

SEQ ID NO: 9785 - protein, 9 aa, Homo sapiens
DEKLGETPL

SEQ ID NO: 9786 - protein, 9 aa, Homo sapiens
RYWSAVTSH

SEQ ID NO: 9787 - protein, 9 aa, Homo sapiens
YIDDLSEEQ

SEQ ID NO: 9788 - protein, 9 aa, Homo sapiens
MVDGVQVAL

SEQ ID NO: 9789 - protein, 9 aa, Homo sapiens
AIASRMEDY

SEQ ID NO: 9790 - protein, 9 aa, Homo sapiens
MEDYLQLPD

SEQ ID NO: 9791 - protein, 9 aa, Homo sapiens
RLADICKED

SEQ ID NO: 9792 - protein, 9 aa, Homo sapiens
KEDVFEQTR

SEQ ID NO: 9793 - protein, 9 aa, Homo sapiens
DVFEQTRVR

SEQ ID NO: 9794 - protein, 9 aa, Homo sapiens
LADICKEDV

SEQ ID NO: 9795 - protein, 9 aa, Homo sapiens
HTQEMGVKR

SEQ ID NO: 9796 - protein, 9 aa, Homo sapiens
GCQNIIGGY

SEQ ID NO: 9797 - protein, 9 aa, Homo sapiens
CQNIIGGYR

SEQ ID NO: 9798 - protein, 9 aa, Homo sapiens
LTYIVALLY

SEQ ID NO: 9799 - protein, 9 aa, Homo sapiens
AQDPSQLSF

SEQ ID NO: 9800 - protein, 9 aa, Homo sapiens
SMKKLTRKQ

SEQ ID NO: 9801 - protein, 9 aa, Homo sapiens
RGGAVQPPR

SEQ ID NO: 9802 - protein, 9 aa, Homo sapiens
RTLRGHRNK

SEQ ID NO: 9803 - protein, 9 aa, Homo sapiens
VELTALRYA

SEQ ID NO: 9804 - protein, 9 aa, Homo sapiens
SGPVLNGQY

SEQ ID NO: 9805 - protein, 9 aa, Homo sapiens
LFHRPRAPR

SEQ ID NO: 9806 - protein, 9 aa, Homo sapiens
LVNEPLAAY

SEQ ID NO: 9807 - protein, 9 aa, Homo sapiens
NEPLAAYSY

SEQ ID NO: 9808 - protein, 9 aa, Homo sapiens
TLDLIRHLR

SEQ ID NO: 9809 - protein, 9 aa, Homo sapiens
ATGKEISKS

SEQ ID NO: 9810 - protein, 9 aa, Homo sapiens
KECGKSFSR

SEQ ID NO: 9811 - protein, 9 aa, Homo sapiens
VSYRGVTYS

SEQ ID NO: 9812 - protein, 9 aa, Homo sapiens
ECDECGKLF

SEQ ID NO: 9813 - protein, 9 aa, Homo sapiens
CASTMLSLR

SEQ ID NO: 9814 - protein, 9 aa, Homo sapiens
RSVSEKNSY

SEQ ID NO: 9815 - protein, 9 aa, Homo sapiens
LSDSSRSVS

SEQ ID NO: 9816 - protein, 9 aa, Homo sapiens
GIWMHRRCK

SEQ ID NO: 9817 - protein, 9 aa, Homo sapiens
WMHRRCKHR

SEQ ID NO: 9818 - protein, 9 aa, Homo sapiens
RRCKHRTGK

SEQ ID NO: 9819 - protein, 9 aa, Homo sapiens
VCKQLCTER

SEQ ID NO: 9820 - protein, 9 aa, Homo sapiens
RIHKLKTNQ

SEQ ID NO: 9821 - protein, 9 aa, Homo sapiens
ALSRDGYVY

SEQ ID NO: 9822 - protein, 9 aa, Homo sapiens
LSRDGYVYK

SEQ ID NO: 9823 - protein, 9 aa, Homo sapiens
TEALSRDGY

SEQ ID NO: 9824 - protein, 9 aa, Homo sapiens
TQNAFLNER

SEQ ID NO: 9825 - protein, 9 aa, Homo sapiens
KGPGLFGER

SEQ ID NO: 9826 - protein, 9 aa, Homo sapiens
DEGDGAIKY

SEQ ID NO: 9827 - protein, 9 aa, Homo sapiens
DSDEGDGAI

SEQ ID NO: 9828 - protein, 9 aa, Homo sapiens
DESEMQDMM

SEQ ID NO: 9829 - protein, 9 aa, Homo sapiens
VTDESEMQD

SEQ ID NO: 9830 - protein, 9 aa, Homo sapiens
RSYVLHRSM

SEQ ID NO: 9831 - protein, 9 aa, Homo sapiens
HSCPSVWKK

SEQ ID NO: 9832 - protein, 9 aa, Homo sapiens
FVSHVNYTF

SEQ ID NO: 9833 - protein, 9 aa, Homo sapiens
VAVSAAVDY

SEQ ID NO: 9834 - protein, 9 aa, Homo sapiens
SAAVDYRSY

SEQ ID NO: 9835 - protein, 9 aa, Homo sapiens
AVSAAVDYR

SEQ ID NO: 9836 - protein, 9 aa, Homo sapiens
TGDGAGSLF

SEQ ID NO: 9837 - protein, 9 aa, Homo sapiens
FEDPFSINS

SEQ ID NO: 9838 - protein, 9 aa, Homo sapiens
FEDPFSINS

SEQ ID NO: 9839 - protein, 9 aa, Homo sapiens
IENYIISPN

SEQ ID NO: 9840 - protein, 9 aa, Homo sapiens
NYIISPNSY

SEQ ID NO: 9841 - protein, 9 aa, Homo sapiens
IISPNSYFR

SEQ ID NO: 9842 - protein, 9 aa, Homo sapiens
NSYFRVLTR

SEQ ID NO: 9843 - protein, 9 aa, Homo sapiens
IENYIISPN

SEQ ID NO: 9844 - protein, 9 aa, Homo sapiens
YIISPNSYF

SEQ ID NO: 9845 - protein, 9 aa, Homo sapiens
PVFTQDMYR

SEQ ID NO: 9846 - protein, 9 aa, Homo sapiens
AFALTLQAR

SEQ ID NO: 9847 - protein, 9 aa, Homo sapiens
KLVYLLRPP

SEQ ID NO: 9848 - protein, 9 aa, Homo sapiens
LTDNFDWTR

SEQ ID NO: 9849 - protein, 9 aa, Homo sapiens
TSHHETNPY

SEQ ID NO: 9850 - protein, 9 aa, Homo sapiens
YTSGIKANS

SEQ ID NO: 9851 - protein, 9 aa, Homo sapiens
GIKANSWLR

SEQ ID NO: 9852 - protein, 9 aa, Homo sapiens
ANSWLRESR

SEQ ID NO: 9853 - protein, 9 aa, Homo sapiens
SDEDICNKY

SEQ ID NO: 9854 - protein, 9 aa, Homo sapiens
SPGGLHYSD

SEQ ID NO: 9855 - protein, 9 aa, Homo sapiens
ILDPPKEDV

SEQ ID NO: 9856 - protein, 9 aa, Homo sapiens
VAVKEKHAR

SEQ ID NO: 9857 - protein, 9 aa, Homo sapiens
SQQATIKWY

SEQ ID NO: 9858 - protein, 9 aa, Homo sapiens
SVVVLLQGY

SEQ ID NO: 9859 - protein, 9 aa, Homo sapiens
DEMEKEETM

SEQ ID NO: 9860 - protein, 9 aa, Homo sapiens
EADEAMAEL

SEQ ID NO: 9861 - protein, 9 aa, Homo sapiens
GQADIFVSK

SEQ ID NO: 9862 - protein, 9 aa, Homo sapiens
QADIFVSKF

SEQ ID NO: 9863 - protein, 9 aa, Homo sapiens
DEEEVIASG

SEQ ID NO: 9864 - protein, 9 aa, Homo sapiens
HLDEEEVIA

SEQ ID NO: 9865 - protein, 9 aa, Homo sapiens
KTAPSSFTK

SEQ ID NO: 9866 - protein, 9 aa, Homo sapiens
FTELRNLTF

SEQ ID NO: 9867 - protein, 9 aa, Homo sapiens
VAACAGTWL

SEQ ID NO: 9868 - protein, 9 aa, Homo sapiens
CQRPHGSGR

SEQ ID NO: 9869 - protein, 9 aa, Homo sapiens
SAFQFWYEE

SEQ ID NO: 9870 - protein, 9 aa, Homo sapiens
GYGGAVSTN

SEQ ID NO: 9871 - protein, 9 aa, Homo sapiens
NTDFGGTLS

SEQ ID NO: 9872 - protein, 9 aa, Homo sapiens
EMSAVFHPA

SEQ ID NO: 9873 - protein, 9 aa, Homo sapiens
AQEEGTSQA

SEQ ID NO: 9874 - protein, 9 aa, Homo sapiens
ARYEFGPAL

SEQ ID NO: 9875 - protein, 9 aa, Homo sapiens
AASGLPGPV

SEQ ID NO: 9876 - protein, 9 aa, Homo sapiens
LPGPVAQGL

SEQ ID NO: 9877 - protein, 9 aa, Homo sapiens
KKYAEEALL

SEQ ID NO: 9878 - protein, 9 aa, Homo sapiens
KAPEALWPA

SEQ ID NO: 9879 - protein, 9 aa, Homo sapiens
TACPSLQEA

SEQ ID NO: 9880 - protein, 9 aa, Homo sapiens
SVAQFLSWA

SEQ ID NO: 9881 - protein, 9 aa, Homo sapiens
AQFLSWASP

SEQ ID NO: 9882 - protein, 9 aa, Homo sapiens
FLSWASPFV

SEQ ID NO: 9883 - protein, 9 aa, Homo sapiens
RLLTHYVKV

SEQ ID NO: 9884 - protein, 9 aa, Homo sapiens
ETARRLLTH

SEQ ID NO: 9885 - protein, 9 aa, Homo sapiens
LIVAHAEAA

SEQ ID NO: 9886 - protein, 9 aa, Homo sapiens
FLAPVAAPV

SEQ ID NO: 9887 - protein, 9 aa, Homo sapiens
LAGDALLSL

SEQ ID NO: 9888 - protein, 9 aa, Homo sapiens
VMLGETNPA

SEQ ID NO: 9889 - protein, 9 aa, Homo sapiens
YLNHLEPPV

SEQ ID NO: 9890 - protein, 9 aa, Homo sapiens
NVRDRLFHA

SEQ ID NO: 9891 - protein, 9 aa, Homo sapiens
MQPISLPRV

SEQ ID NO: 9892 - protein, 9 aa, Homo sapiens
MTLEGLYLA

SEQ ID NO: 9893 - protein, 9 aa, Homo sapiens
QLHGGLELE

SEQ ID NO: 9894 - protein, 9 aa, Homo sapiens
SLGDRVPYV

SEQ ID NO: 9895 - protein, 9 aa, Homo sapiens
RVPYVIISA

SEQ ID NO: 9896 - protein, 9 aa, Homo sapiens
NQHPQSPAV

SEQ ID NO: 9897 - protein, 9 aa, Homo sapiens
IQVLKEWNM

SEQ ID NO: 9898 - protein, 9 aa, Homo sapiens
RVAAQNMLA

SEQ ID NO: 9899 - protein, 9 aa, Homo sapiens
AQNMLAQEA

SEQ ID NO: 9900 - protein, 9 aa, Homo sapiens
NMLAQEAEM

SEQ ID NO: 9901 - protein, 9 aa, Homo sapiens
IVLSLDVPI

SEQ ID NO: 9902 - protein, 9 aa, Homo sapiens
LTAAVIDNI

SEQ ID NO: 9903 - protein, 9 aa, Homo sapiens
NIRLCFHGL

SEQ ID NO: 9904 - protein, 9 aa, Homo sapiens
CLQASVTSV

SEQ ID NO: 9905 - protein, 9 aa, Homo sapiens
AAAAAAAAA

SEQ ID NO: 9906 - protein, 9 aa, Homo sapiens
AAAAAAAAA

SEQ ID NO: 9907 - protein, 9 aa, Homo sapiens
TLEDALSNV

SEQ ID NO: 9908 - protein, 9 aa, Homo sapiens
LLLGMVGRA

SEQ ID NO: 9909 - protein, 9 aa, Homo sapiens
AAAAGAAAL

SEQ ID NO: 9910 - protein, 9 aa, Homo sapiens
LAPPSALHV

SEQ ID NO: 9911 - protein, 9 aa, Homo sapiens
SALHVYYGA

SEQ ID NO: 9912 - protein, 9 aa, Homo sapiens
YAVSAQGFH

SEQ ID NO: 9913 - protein, 9 aa, Homo sapiens
AAAVSAPER

SEQ ID NO: 9914 - protein, 9 aa, Homo sapiens
SISQEDIAR

SEQ ID NO: 9915 - protein, 9 aa, Homo sapiens
STFPGTFLE

SEQ ID NO: 9916 - protein, 9 aa, Homo sapiens
DREFAVASR

SEQ ID NO: 9917 - protein, 9 aa, Homo sapiens
ELQRCLVER

SEQ ID NO: 9918 - protein, 9 aa, Homo sapiens
QTFKAEPPG

SEQ ID NO: 9919 - protein, 9 aa, Homo sapiens
ALLAPCEAR

SEQ ID NO: 9920 - protein, 9 aa, Homo sapiens
TAYPREDTR

SEQ ID NO: 9921 - protein, 9 aa, Homo sapiens
LTPELMVPR

SEQ ID NO: 9922 - protein, 9 aa, Homo sapiens
KVDDAMLMF

SEQ ID NO: 9923 - protein, 9 aa, Homo sapiens
LADYLHAMR

SEQ ID NO: 9924 - protein, 9 aa, Homo sapiens
EGSRIPQAR

SEQ ID NO: 9925 - protein, 9 aa, Homo sapiens
STNVPAWLK

SEQ ID NO: 9926 - protein, 9 aa, Homo sapiens
VPAWLKSLR

SEQ ID NO: 9927 - protein, 9 aa, Homo sapiens
TATTQEASK

SEQ ID NO: 9928 - protein, 9 aa, Homo sapiens
VVVVVAKPK

SEQ ID NO: 9929 - protein, 9 aa, Homo sapiens
TYQGSYGFR

SEQ ID NO: 9930 - protein, 9 aa, Homo sapiens
LEKEITTYR

SEQ ID NO: 9931 - protein, 9 aa, Homo sapiens
EKEITTYRR

SEQ ID NO: 9932 - protein, 9 aa, Homo sapiens
VAQAQVKLR

SEQ ID NO: 9933 - protein, 9 aa, Homo sapiens
AVRTVRVLR

SEQ ID NO: 9934 - protein, 9 aa, Homo sapiens
TVRVLRPLR

SEQ ID NO: 9935 - protein, 9 aa, Homo sapiens
VGTGDEALR

SEQ ID NO: 9936 - protein, 9 aa, Homo sapiens
TAPGTPWQR

SEQ ID NO: 9937 - protein, 9 aa, Homo sapiens
SSNLTTHKK

SEQ ID NO: 9938 - protein, 9 aa, Homo sapiens
SVREASLCK

SEQ ID NO: 9939 - protein, 9 aa, Homo sapiens
RSTLIEHQR

SEQ ID NO: 9940 - protein, 9 aa, Homo sapiens
LAQENVWLR

SEQ ID NO: 9941 - protein, 9 aa, Homo sapiens
HNEVIGVCR

SEQ ID NO: 9942 - protein, 9 aa, Homo sapiens
HNEVIGVCR

SEQ ID NO: 9943 - protein, 9 aa, Homo sapiens
HLVIHTGEN

SEQ ID NO: 9944 - protein, 9 aa, Homo sapiens
EEDIVDFLR

SEQ ID NO: 9945 - protein, 9 aa, Homo sapiens
EDIVDFLRR

SEQ ID NO: 9946 - protein, 9 aa, Homo sapiens
MTAVAFDRY

SEQ ID NO: 9947 - protein, 9 aa, Homo sapiens
SMTAVAFDR

SEQ ID NO: 9948 - protein, 9 aa, Homo sapiens
LSVSWEASR

SEQ ID NO: 9949 - protein, 9 aa, Homo sapiens
NSNPEQDLK

SEQ ID NO: 9950 - protein, 9 aa, Homo sapiens
HVAAECPSK

SEQ ID NO: 9951 - protein, 9 aa, Homo sapiens
CNKCGKFFR

SEQ ID NO: 9952 - protein, 9 aa, Homo sapiens
HLDSQGNPY

SEQ ID NO: 9953 - protein, 9 aa, Homo sapiens
LTDKLQALR

SEQ ID NO: 9954 - protein, 9 aa, Homo sapiens
SASVQVLVR

SEQ ID NO: 9955 - protein, 9 aa, Homo sapiens
IYTIMRWFR

SEQ ID NO: 9956 - protein, 9 aa, Homo sapiens
YTIMRWFRR

SEQ ID NO: 9957 - protein, 9 aa, Homo sapiens
EERGKVFSR

SEQ ID NO: 9958 - protein, 9 aa, Homo sapiens
SSDGWLEGV

SEQ ID NO: 9959 - protein, 9 aa, Homo sapiens
SLRVATSLG

SEQ ID NO: 9960 - protein, 9 aa, Homo sapiens
TVATIMVLV

SEQ ID NO: 9961 - protein, 9 aa, Homo sapiens
LAEELNHGR

SEQ ID NO: 9962 - protein, 9 aa, Homo sapiens
SPDAPDHTS

SEQ ID NO: 9963 - protein, 9 aa, Homo sapiens
SETSHSPLY

SEQ ID NO: 9964 - protein, 9 aa, Homo sapiens
LPLTEGRQL

SEQ ID NO: 9965 - protein, 9 aa, Homo sapiens
LPLTEGRQL

SEQ ID NO: 9966 - protein, 9 aa, Homo sapiens
VPLEATDSL

SEQ ID NO: 9967 - protein, 9 aa, Homo sapiens
GPREQSTYV

SEQ ID NO: 9968 - protein, 9 aa, Homo sapiens
ATQLSESYY

SEQ ID NO: 9969 - protein, 9 aa, Homo sapiens
VATQLSESY

SEQ ID NO: 9970 - protein, 9 aa, Homo sapiens
VSLLDDTVY

SEQ ID NO: 9971 - protein, 9 aa, Homo sapiens
APILNMSSS

SEQ ID NO: 9972 - protein, 9 aa, Homo sapiens
FPGPPTHWL

SEQ ID NO: 9973 - protein, 9 aa, Homo sapiens
SPTAEHHPE

SEQ ID NO: 9974 - protein, 9 aa, Homo sapiens
TGKSYLMNK

SEQ ID NO: 9975 - protein, 9 aa, Homo sapiens
YLMNKLAGK

SEQ ID NO: 9976 - protein, 9 aa, Homo sapiens
YRTGKSYLM

SEQ ID NO: 9977 - protein, 9 aa, Homo sapiens
HPNEQKEGT

SEQ ID NO: 9978 - protein, 9 aa, Homo sapiens
TPAPFGDQS

SEQ ID NO: 9979 - protein, 9 aa, Homo sapiens
WSEGEEHGY

SEQ ID NO: 9980 - protein, 9 aa, Homo sapiens
WSEGEEHGY

SEQ ID NO: 9981 - protein, 9 aa, Homo sapiens
NYENVPRVL

SEQ ID NO: 9982 - protein, 9 aa, Homo sapiens
MTHVTLLIY

SEQ ID NO: 9983 - protein, 9 aa, Homo sapiens
AVCESIYQK

SEQ ID NO: 9984 - protein, 9 aa, Homo sapiens
QIAVCESIY

SEQ ID NO: 9985 - protein, 9 aa, Homo sapiens
IYQKLCEIL

SEQ ID NO: 9986 - protein, 9 aa, Homo sapiens
RILAPNSNY

SEQ ID NO: 9987 - protein, 9 aa, Homo sapiens
APNSNYQDV

SEQ ID NO: 9988 - protein, 9 aa, Homo sapiens
ITANTSDAY

SEQ ID NO: 9989 - protein, 9 aa, Homo sapiens
ITANTSDAY

SEQ ID NO: 9990 - protein, 9 aa, Homo sapiens
TANTSDAYL

SEQ ID NO: 9991 - protein, 9 aa, Homo sapiens
KAKFENFNK

SEQ ID NO: 9992 - protein, 9 aa, Homo sapiens
RMPEDQVAR

SEQ ID NO: 9993 - protein, 9 aa, Homo sapiens
PLYIGNRMK

SEQ ID NO: 9994 - protein, 9 aa, Homo sapiens
EPLYIGNRM

SEQ ID NO: 9995 - protein, 9 aa, Homo sapiens
MTLVLSMNR

SEQ ID NO: 9996 - protein, 9 aa, Homo sapiens
SLSWSRLPR

SEQ ID NO: 9997 - protein, 9 aa, Homo sapiens
QSAESSDSL

SEQ ID NO: 9998 - protein, 9 aa, Homo sapiens
VTYLKKAGR

SEQ ID NO: 9999 - protein, 9 aa, Homo sapiens
YLKKAGRPG

SEQ ID NO: 10000 - protein, 9 aa, Homo sapiens
MVRWAQESV

SEQ ID NO: 10001 - protein, 9 aa, Homo sapiens
VRWAQESVI

SEQ ID NO: 10002 - protein, 9 aa, Homo sapiens
AAVCHPLRY

SEQ ID NO: 10003 - protein, 9 aa, Homo sapiens
TLFYGAALY

SEQ ID NO: 10004 - protein, 9 aa, Homo sapiens
TLFYGAALY

SEQ ID NO: 10005 - protein, 9 aa, Homo sapiens
FYGAALYTY

SEQ ID NO: 10006 - protein, 9 aa, Homo sapiens
FYGAALYTY

SEQ ID NO: 10007 - protein, 9 aa, Homo sapiens
HPRFCASLA

SEQ ID NO: 10008 - protein, 9 aa, Homo sapiens
YIAIMHPRF

SEQ ID NO: 10009 - protein, 9 aa, Homo sapiens
HPRFCASLA

SEQ ID NO: 10010 - protein, 9 aa, Homo sapiens
RYIAIMHPR

SEQ ID NO: 10011 - protein, 9 aa, Homo sapiens
RAKGQVLTK

SEQ ID NO: 10012 - protein, 9 aa, Homo sapiens
KLRAKGQVL

SEQ ID NO: 10013 - protein, 9 aa, Homo sapiens
LPVLAKMAA

SEQ ID NO: 10014 - protein, 9 aa, Homo sapiens
LPVLAKMAA

SEQ ID NO: 10015 - protein, 9 aa, Homo sapiens
CAMAVLLTK

SEQ ID NO: 10016 - protein, 9 aa, Homo sapiens
KAFRKSSTL

SEQ ID NO: 10017 - protein, 9 aa, Homo sapiens
AVLSRTAPT

SEQ ID NO: 10018 - protein, 9 aa, Homo sapiens
APTGPGSRC

SEQ ID NO: 10019 - protein, 9 aa, Homo sapiens
LSLLRSLDY

SEQ ID NO: 10020 - protein, 9 aa, Homo sapiens
RLPPPTILK

SEQ ID NO: 10021 - protein, 9 aa, Homo sapiens
VRLPPPTIL

SEQ ID NO: 10022 - protein, 9 aa, Homo sapiens
QPGKTRVTI

SEQ ID NO: 10023 - protein, 9 aa, Homo sapiens
MYVAIQAVL

SEQ ID NO: 10024 - protein, 9 aa, Homo sapiens
APRGLHVVT

SEQ ID NO: 10025 - protein, 9 aa, Homo sapiens
KILLEHCRK

SEQ ID NO: 10026 - protein, 9 aa, Homo sapiens
CRKHKYLAK

SEQ ID NO: 10027 - protein, 9 aa, Homo sapiens
VPHNPAPPM

SEQ ID NO: 10028 - protein, 9 aa, Homo sapiens
NPAPPMSTV

SEQ ID NO: 10029 - protein, 9 aa, Homo sapiens
YAQACHDAG

SEQ ID NO: 10030 - protein, 9 aa, Homo sapiens
LVNLGFQAL

SEQ ID NO: 10031 - protein, 9 aa, Homo sapiens
PPREGGAHI

SEQ ID NO: 10032 - protein, 9 aa, Homo sapiens
LLAFFSFFT

SEQ ID NO: 10033 - protein, 9 aa, Homo sapiens
FFSFFTHRF

SEQ ID NO: 10034 - protein, 9 aa, Homo sapiens
HIWIGVPFF

SEQ ID NO: 10035 - protein, 9 aa, Homo sapiens
IGVPFFFVY

SEQ ID NO: 10036 - protein, 9 aa, Homo sapiens
RIQSGLGAL

SEQ ID NO: 10037 - protein, 9 aa, Homo sapiens
HPRADTAPP

SEQ ID NO: 10038 - protein, 9 aa, Homo sapiens
TFFPCASGI

SEQ ID NO: 10039 - protein, 9 aa, Homo sapiens
YLQKFMNAH

SEQ ID NO: 10040 - protein, 9 aa, Homo sapiens
FMNAHNALK

SEQ ID NO: 10041 - protein, 9 aa, Homo sapiens
YLQKFMNAH

SEQ ID NO: 10042 - protein, 9 aa, Homo sapiens
KFMNAHNAL

SEQ ID NO: 10043 - protein, 9 aa, Homo sapiens
SPRVCCLMV

SEQ ID NO: 10044 - protein, 9 aa, Homo sapiens
IIMSPRVCC

SEQ ID NO: 10045 - protein, 9 aa, Homo sapiens
IMSPRVCCL

SEQ ID NO: 10046 - protein, 9 aa, Homo sapiens
LALMAYDRY

SEQ ID NO: 10047 - protein, 9 aa, Homo sapiens
MSNTNGSAI

SEQ ID NO: 10048 - protein, 9 aa, Homo sapiens
MSNTNGSAI

SEQ ID NO: 10049 - protein, 9 aa, Homo sapiens
FPFIYIITL

SEQ ID NO: 10050 - protein, 9 aa, Homo sapiens
ITFPFIYII

SEQ ID NO: 10051 - protein, 9 aa, Homo sapiens
FPFIYIITL

SEQ ID NO: 10052 - protein, 9 aa, Homo sapiens
HFVPCVYIY

SEQ ID NO: 10053 - protein, 9 aa, Homo sapiens
HFVPCVYIY

SEQ ID NO: 10054 - protein, 9 aa, Homo sapiens
YPFLGALCF

SEQ ID NO: 10055 - protein, 9 aa, Homo sapiens
RLRSVAFPC

SEQ ID NO: 10056 - protein, 9 aa, Homo sapiens
FPCISTGVF

SEQ ID NO: 10057 - protein, 9 aa, Homo sapiens
FPCISTGVF

SEQ ID NO: 10058 - protein, 9 aa, Homo sapiens
CISTGVFGY

SEQ ID NO: 10059 - protein, 9 aa, Homo sapiens
RLRSVAFPC

SEQ ID NO: 10060 - protein, 9 aa, Homo sapiens
VLLSSEQLF

SEQ ID NO: 10061 - protein, 9 aa, Homo sapiens
KRLEAYVLL

SEQ ID NO: 10062 - protein, 9 aa, Homo sapiens
NFYPERFTY

SEQ ID NO: 10063 - protein, 9 aa, Homo sapiens
NFYPERFTY

SEQ ID NO: 10064 - protein, 9 aa, Homo sapiens
DYVLCSPEM

SEQ ID NO: 10065 - protein, 9 aa, Homo sapiens
SMDALLGGS

SEQ ID NO: 10066 - protein, 9 aa, Homo sapiens
KHKPDQMTI

SEQ ID NO: 10067 - protein, 9 aa, Homo sapiens
VSLCYRLTY

SEQ ID NO: 10068 - protein, 9 aa, Homo sapiens
IFGPPWMAF

SEQ ID NO: 10069 - protein, 9 aa, Homo sapiens
TLRNKEVKK

SEQ ID NO: 10070 - protein, 9 aa, Homo sapiens
HYFCDLFPL

SEQ ID NO: 10071 - protein, 9 aa, Homo sapiens
FPLLGLSCS

SEQ ID NO: 10072 - protein, 9 aa, Homo sapiens
HYFCDLFPL

SEQ ID NO: 10073 - protein, 9 aa, Homo sapiens
YFCDLFPLL

SEQ ID NO: 10074 - protein, 9 aa, Homo sapiens
DTQENVMEY

SEQ ID NO: 10075 - protein, 9 aa, Homo sapiens
NVMEYLHVL

SEQ ID NO: 10076 - protein, 9 aa, Homo sapiens
MPATPNFLA

SEQ ID NO: 10077 - protein, 9 aa, Homo sapiens
FLANPSSSS

SEQ ID NO: 10078 - protein, 9 aa, Homo sapiens
MPATPNFLA

SEQ ID NO: 10079 - protein, 9 aa, Homo sapiens
FLANPSSSS

SEQ ID NO: 10080 - protein, 9 aa, Homo sapiens
VPEHSNNKM

SEQ ID NO: 10081 - protein, 9 aa, Homo sapiens
PLTHSSSNK

SEQ ID NO: 10082 - protein, 9 aa, Homo sapiens
LPLTHSSSN

SEQ ID NO: 10083 - protein, 9 aa, Homo sapiens
FLFNGNFLL

SEQ ID NO: 10084 - protein, 9 aa, Homo sapiens
YLSHGASQR

SEQ ID NO: 10085 - protein, 9 aa, Homo sapiens
TATLPTVRM

SEQ ID NO: 10086 - protein, 9 aa, Homo sapiens
LAVLLSLRF

SEQ ID NO: 10087 - protein, 9 aa, Homo sapiens
NPNQRLPKV

SEQ ID NO: 10088 - protein, 9 aa, Homo sapiens
QRLPKVEIL

SEQ ID NO: 10089 - protein, 9 aa, Homo sapiens
DMMPKYLNF

SEQ ID NO: 10090 - protein, 9 aa, Homo sapiens
MPKYLNFVK

SEQ ID NO: 10091 - protein, 9 aa, Homo sapiens
SPVPIITPT

SEQ ID NO: 10092 - protein, 9 aa, Homo sapiens
SPVPIITPT

SEQ ID NO: 10093 - protein, 9 aa, Homo sapiens
RVRPELKTK

SEQ ID NO: 10094 - protein, 9 aa, Homo sapiens
RPHVAGKPR

SEQ ID NO: 10095 - protein, 9 aa, Homo sapiens
VAGKPRAGA

SEQ ID NO: 10096 - protein, 9 aa, Homo sapiens
TVLFSTAHK

SEQ ID NO: 10097 - protein, 9 aa, Homo sapiens
SLYCPFFSL

SEQ ID NO: 10098 - protein, 9 aa, Homo sapiens
KMDDASISR

SEQ ID NO: 10099 - protein, 9 aa, Homo sapiens
VANTSTQTV

SEQ ID NO: 10100 - protein, 9 aa, Homo sapiens
NMYLSRLRR

SEQ ID NO: 10101 - protein, 9 aa, Homo sapiens
MYLSRLRRI

SEQ ID NO: 10102 - protein, 9 aa, Homo sapiens
SSSLPSPRK

SEQ ID NO: 10103 - protein, 9 aa, Homo sapiens
FSMDDSSSL

SEQ ID NO: 10104 - protein, 9 aa, Homo sapiens
LVERKTISF

SEQ ID NO: 10105 - protein, 9 aa, Homo sapiens
IPFAVNLPF

SEQ ID NO: 10106 - protein, 9 aa, Homo sapiens
IPFAVNLPF

SEQ ID NO: 10107 - protein, 9 aa, Homo sapiens
FQIPFAVNL

SEQ ID NO: 10108 - protein, 9 aa, Homo sapiens
CPSGSRRAS

SEQ ID NO: 10109 - protein, 9 aa, Homo sapiens
LPLWRARGF

SEQ ID NO: 10110 - protein, 9 aa, Homo sapiens
LPLWRARGF

SEQ ID NO: 10111 - protein, 9 aa, Homo sapiens
AQYAYPGAR

SEQ ID NO: 10112 - protein, 9 aa, Homo sapiens
TLFKSLMDR

SEQ ID NO: 10113 - protein, 9 aa, Homo sapiens
LFKSLMDRF

SEQ ID NO: 10114 - protein, 9 aa, Homo sapiens
DVLAQQFAL

SEQ ID NO: 10115 - protein, 9 aa, Homo sapiens
FALMAPLLF

SEQ ID NO: 10116 - protein, 9 aa, Homo sapiens
QFALMAPLL

SEQ ID NO: 10117 - protein, 9 aa, Homo sapiens
KALIIVAVQ

SEQ ID NO: 10118 - protein, 9 aa, Homo sapiens
LSDKFRKEY

SEQ ID NO: 10119 - protein, 9 aa, Homo sapiens
KFRKEYYAL

SEQ ID NO: 10120 - protein, 9 aa, Homo sapiens
TKWPSHGAF

SEQ ID NO: 10121 - protein, 9 aa, Homo sapiens
RHMKTHMHK

SEQ ID NO: 10122 - protein, 9 aa, Homo sapiens
VPRFSFPAP

SEQ ID NO: 10123 - protein, 9 aa, Homo sapiens
ASVDVSAPK

SEQ ID NO: 10124 - protein, 9 aa, Homo sapiens
QASVDVSAP

SEQ ID NO: 10125 - protein, 9 aa, Homo sapiens
ISARNSLPK

SEQ ID NO: 10126 - protein, 9 aa, Homo sapiens
ALIAWAAQR

SEQ ID NO: 10127 - protein, 9 aa, Homo sapiens
LIAWAAQRF

SEQ ID NO: 10128 - protein, 9 aa, Homo sapiens
KSGSGNSGK

SEQ ID NO: 10129 - protein, 9 aa, Homo sapiens
FASEHAVLI

SEQ ID NO: 10130 - protein, 9 aa, Homo sapiens
RPIRSRSTA

SEQ ID NO: 10131 - protein, 9 aa, Homo sapiens
TAVMPKVSL

SEQ ID NO: 10132 - protein, 9 aa, Homo sapiens
SHYGTKGLK

SEQ ID NO: 10133 - protein, 9 aa, Homo sapiens
FVNNNAQDY

SEQ ID NO: 10134 - protein, 9 aa, Homo sapiens
FVNNNAQDY

SEQ ID NO: 10135 - protein, 9 aa, Homo sapiens
CRLRSKLAL

SEQ ID NO: 10136 - protein, 9 aa, Homo sapiens
YPHPLPSPG

SEQ ID NO: 10137 - protein, 9 aa, Homo sapiens
HPLPSPGGV

SEQ ID NO: 10138 - protein, 9 aa, Homo sapiens
YPHPLPSPG

SEQ ID NO: 10139 - protein, 9 aa, Homo sapiens
LPSPGGVLY

SEQ ID NO: 10140 - protein, 9 aa, Homo sapiens
SPGGVLYTW

SEQ ID NO: 10141 - protein, 9 aa, Homo sapiens
IPAAPRKPR

SEQ ID NO: 10142 - protein, 9 aa, Homo sapiens
HASCHVQFF

SEQ ID NO: 10143 - protein, 9 aa, Homo sapiens
QIDETRMGY

SEQ ID NO: 10144 - protein, 9 aa, Homo sapiens
VVQASQGGQ

SEQ ID NO: 10145 - protein, 9 aa, Homo sapiens
QASQGGQLF

SEQ ID NO: 10146 - protein, 9 aa, Homo sapiens
LAVIVLVAL

SEQ ID NO: 10147 - protein, 9 aa, Homo sapiens
CVVAGLPSM

SEQ ID NO: 10148 - protein, 9 aa, Homo sapiens
MPGPAAGSR

SEQ ID NO: 10149 - protein, 9 aa, Homo sapiens
AAGSRARVY

SEQ ID NO: 10150 - protein, 9 aa, Homo sapiens
YAQNHGVYL

SEQ ID NO: 10151 - protein, 9 aa, Homo sapiens
LPGSPAYAQ

SEQ ID NO: 10152 - protein, 9 aa, Homo sapiens
YAQNHGVYL

SEQ ID NO: 10153 - protein, 9 aa, Homo sapiens
HVRIAEAAT

SEQ ID NO: 10154 - protein, 9 aa, Homo sapiens
RIAEAATLK

SEQ ID NO: 10155 - protein, 9 aa, Homo sapiens
TLKPPPFLR

SEQ ID NO: 10156 - protein, 9 aa, Homo sapiens
ILACRNMAR

SEQ ID NO: 10157 - protein, 9 aa, Homo sapiens
GLDVGLTGT

SEQ ID NO: 10158 - protein, 9 aa, Homo sapiens
YHYKDLWVL

SEQ ID NO: 10159 - protein, 9 aa, Homo sapiens
MPQVTVDVL

SEQ ID NO: 10160 - protein, 9 aa, Homo sapiens
MPQVTVDVL

SEQ ID NO: 10161 - protein, 9 aa, Homo sapiens
VTVDVLQRM

SEQ ID NO: 10162 - protein, 9 aa, Homo sapiens
HLHEPAVLY

SEQ ID NO: 10163 - protein, 9 aa, Homo sapiens
HLHEPAVLY

SEQ ID NO: 10164 - protein, 9 aa, Homo sapiens
LLLALTLPF

SEQ ID NO: 10165 - protein, 9 aa, Homo sapiens
LALTLPFAA

SEQ ID NO: 10166 - protein, 9 aa, Homo sapiens
SPIRNRTPF

SEQ ID NO: 10167 - protein, 9 aa, Homo sapiens
SPIRNRTPF

SEQ ID NO: 10168 - protein, 9 aa, Homo sapiens
HAMFGNDTI

SEQ ID NO: 10169 - protein, 9 aa, Homo sapiens
KVRDGVAIL

SEQ ID NO: 10170 - protein, 9 aa, Homo sapiens
LSTGLGSTH

SEQ ID NO: 10171 - protein, 9 aa, Homo sapiens
HPDQQHVAS

SEQ ID NO: 10172 - protein, 9 aa, Homo sapiens
KVKAVRTSL

SEQ ID NO: 10173 - protein, 9 aa, Homo sapiens
LSDRTRLLE

SEQ ID NO: 10174 - protein, 9 aa, Homo sapiens
KPPLSDRTR

SEQ ID NO: 10175 - protein, 9 aa, Homo sapiens
PPLSDRTRL

SEQ ID NO: 10176 - protein, 9 aa, Homo sapiens
STIDPSSVM

SEQ ID NO: 10177 - protein, 9 aa, Homo sapiens
LGAGAGSTF

SEQ ID NO: 10178 - protein, 9 aa, Homo sapiens
LGAGAGSTF

SEQ ID NO: 10179 - protein, 9 aa, Homo sapiens
RSLDHLHPE

SEQ ID NO: 10180 - protein, 9 aa, Homo sapiens
AVAAAVAAV

SEQ ID NO: 10181 - protein, 9 aa, Homo sapiens
EAVAAAVAA

SEQ ID NO: 10182 - protein, 9 aa, Homo sapiens
RLTDQQQRL

SEQ ID NO: 10183 - protein, 9 aa, Homo sapiens
TPLTTTGSA

SEQ ID NO: 10184 - protein, 9 aa, Homo sapiens
LTTTGSAEM

SEQ ID NO: 10185 - protein, 9 aa, Homo sapiens
SVPTPTLAK

SEQ ID NO: 10186 - protein, 9 aa, Homo sapiens
RPVRTFSTM

SEQ ID NO: 10187 - protein, 9 aa, Homo sapiens
RPVRTFSTM

SEQ ID NO: 10188 - protein, 9 aa, Homo sapiens
RVRSTISSL

SEQ ID NO: 10189 - protein, 9 aa, Homo sapiens
MFMSTMDAL

SEQ ID NO: 10190 - protein, 9 aa, Homo sapiens
RLAATKCRK

SEQ ID NO: 10191 - protein, 9 aa, Homo sapiens
EAAWTLLEP

SEQ ID NO: 10192 - protein, 9 aa, Homo sapiens
RPSGELFAI

SEQ ID NO: 10193 - protein, 9 aa, Homo sapiens
EFRPSGELF

SEQ ID NO: 10194 - protein, 9 aa, Homo sapiens
ALRLTAVVL

SEQ ID NO: 10195 - protein, 9 aa, Homo sapiens
EATARALGK

SEQ ID NO: 10196 - protein, 9 aa, Homo sapiens
VLGGPSVSL

SEQ ID NO: 10197 - protein, 9 aa, Homo sapiens
ELGEYYMKK

SEQ ID NO: 10198 - protein, 9 aa, Homo sapiens
PPAQYSWTI

SEQ ID NO: 10199 - protein, 9 aa, Homo sapiens
PPAQYSWTI

SEQ ID NO: 10200 - protein, 9 aa, Homo sapiens
PPAQYSWTI

SEQ ID NO: 10201 - protein, 9 aa, Homo sapiens
LGFMCEVKK

SEQ ID NO: 10202 - protein, 9 aa, Homo sapiens
APADQGAEA

SEQ ID NO: 10203 - protein, 9 aa, Homo sapiens
HLSQPPPMK

SEQ ID NO: 10204 - protein, 9 aa, Homo sapiens
WPHLSQPPP

SEQ ID NO: 10205 - protein, 9 aa, Homo sapiens
WPHLSQPPP

SEQ ID NO: 10206 - protein, 9 aa, Homo sapiens
KMRPISGVT

SEQ ID NO: 10207 - protein, 9 aa, Homo sapiens
KMRPISGVT

SEQ ID NO: 10208 - protein, 9 aa, Homo sapiens
IPVATNNPA

SEQ ID NO: 10209 - protein, 9 aa, Homo sapiens
IPVATNNPA

SEQ ID NO: 10210 - protein, 9 aa, Homo sapiens
SPGPASPVS

SEQ ID NO: 10211 - protein, 9 aa, Homo sapiens
APSSPSSPI

SEQ ID NO: 10212 - protein, 9 aa, Homo sapiens
QPLRARSLL

SEQ ID NO: 10213 - protein, 9 aa, Homo sapiens
QPLRARSLL

SEQ ID NO: 10214 - protein, 9 aa, Homo sapiens
ETFNSFLRR

SEQ ID NO: 10215 - protein, 9 aa, Homo sapiens
SMQGHGTWL

SEQ ID NO: 10216 - protein, 9 aa, Homo sapiens
FPGGLMGPV

SEQ ID NO: 10217 - protein, 9 aa, Homo sapiens
FPGGLMGPV

SEQ ID NO: 10218 - protein, 9 aa, Homo sapiens
KPHCMTVRA

SEQ ID NO: 10219 - protein, 9 aa, Homo sapiens
IVQNGKHFK

SEQ ID NO: 10220 - protein, 9 aa, Homo sapiens
SPAEAEFNY

SEQ ID NO: 10221 - protein, 9 aa, Homo sapiens
NPYPYSDAI

SEQ ID NO: 10222 - protein, 9 aa, Homo sapiens
NPYPYSDAI

SEQ ID NO: 10223 - protein, 9 aa, Homo sapiens
YPYSDAINT

SEQ ID NO: 10224 - protein, 9 aa, Homo sapiens
LTNFSFQAK

SEQ ID NO: 10225 - protein, 9 aa, Homo sapiens
SRSPPMLPV

SEQ ID NO: 10226 - protein, 9 aa, Homo sapiens
DVISRSQLY

SEQ ID NO: 10227 - protein, 9 aa, Homo sapiens
NLSVIVLEK

SEQ ID NO: 10228 - protein, 9 aa, Homo sapiens
LGVPTGRPY

SEQ ID NO: 10229 - protein, 9 aa, Homo sapiens
RPYNVDTES

SEQ ID NO: 10230 - protein, 9 aa, Homo sapiens
GMLRDLLLR

SEQ ID NO: 10231 - protein, 9 aa, Homo sapiens
RTVLGADSK

SEQ ID NO: 10232 - protein, 9 aa, Homo sapiens
EAAGIPVSF

SEQ ID NO: 10233 - protein, 9 aa, Homo sapiens
CHFQESTEL

SEQ ID NO: 10234 - protein, 9 aa, Homo sapiens
QLRQTVCRK

SEQ ID NO: 10235 - protein, 9 aa, Homo sapiens
HTIPWDGKK

SEQ ID NO: 10236 - protein, 9 aa, Homo sapiens
QPRYFMHAY

SEQ ID NO: 10237 - protein, 9 aa, Homo sapiens
RVETHFQPR

SEQ ID NO: 10238 - protein, 9 aa, Homo sapiens
KPSGGGRCT

SEQ ID NO: 10239 - protein, 9 aa, Homo sapiens
GHSPPVLPL

SEQ ID NO: 10240 - protein, 9 aa, Homo sapiens
EAERTSGAF

SEQ ID NO: 10241 - protein, 9 aa, Homo sapiens
SPPPKDTLL

SEQ ID NO: 10242 - protein, 9 aa, Homo sapiens
QAAYADSGS

SEQ ID NO: 10243 - protein, 9 aa, Homo sapiens
AAYADSGSF

SEQ ID NO: 10244 - protein, 9 aa, Homo sapiens
YADSGSFLH

SEQ ID NO: 10245 - protein, 9 aa, Homo sapiens
RERLRKVLK

SEQ ID NO: 10246 - protein, 9 aa, Homo sapiens
KARVHRSKK

SEQ ID NO: 10247 - protein, 9 aa, Homo sapiens
IPVPVVSAL

SEQ ID NO: 10248 - protein, 9 aa, Homo sapiens
EPDYVTIPV

SEQ ID NO: 10249 - protein, 9 aa, Homo sapiens
IPVPVVSAL

SEQ ID NO: 10250 - protein, 9 aa, Homo sapiens
KPGDRVALV

SEQ ID NO: 10251 - protein, 9 aa, Homo sapiens
HLAVVSLCY

SEQ ID NO: 10252 - protein, 9 aa, Homo sapiens
VVSLCYSSL

SEQ ID NO: 10253 - protein, 9 aa, Homo sapiens
HLAVVSLCY

SEQ ID NO: 10254 - protein, 9 aa, Homo sapiens
LCYSSLMVM

SEQ ID NO: 10255 - protein, 9 aa, Homo sapiens
ISDPVLLVG

SEQ ID NO: 10256 - protein, 9 aa, Homo sapiens
LLVGTTIQY

SEQ ID NO: 10257 - protein, 9 aa, Homo sapiens
PRHTQFDPF

SEQ ID NO: 10258 - protein, 9 aa, Homo sapiens
DALVCSCFI

SEQ ID NO: 10259 - protein, 9 aa, Homo sapiens
LVCSCFIPF

SEQ ID NO: 10260 - protein, 9 aa, Homo sapiens
IPFYSGLIP

SEQ ID NO: 10261 - protein, 9 aa, Homo sapiens
CFIPFYSGL

SEQ ID NO: 10262 - protein, 9 aa, Homo sapiens
AARARRRAW

SEQ ID NO: 10263 - protein, 9 aa, Homo sapiens
GVGAAVMRY

SEQ ID NO: 10264 - protein, 9 aa, Homo sapiens
LLRGVGAAV

SEQ ID NO: 10265 - protein, 9 aa, Homo sapiens
YRFDLLRGV

SEQ ID NO: 10266 - protein, 9 aa, Homo sapiens
VYLMFLLLK

SEQ ID NO: 10267 - protein, 9 aa, Homo sapiens
MFLLLKFSK

SEQ ID NO: 10268 - protein, 9 aa, Homo sapiens
YLMFLLLKF

SEQ ID NO: 10269 - protein, 9 aa, Homo sapiens
LPNGYMTDL

SEQ ID NO: 10270 - protein, 9 aa, Homo sapiens
FIANLPNGY

SEQ ID NO: 10271 - protein, 9 aa, Homo sapiens
LALGLALAL

SEQ ID NO: 10272 - protein, 9 aa, Homo sapiens
EPAGAWLAL

SEQ ID NO: 10273 - protein, 9 aa, Homo sapiens
LALGLALAL

SEQ ID NO: 10274 - protein, 9 aa, Homo sapiens
FYGGKVHRV

SEQ ID NO: 10275 - protein, 9 aa, Homo sapiens
IPQEQENIF

SEQ ID NO: 10276 - protein, 9 aa, Homo sapiens
ILAVVTMAY

SEQ ID NO: 10277 - protein, 9 aa, Homo sapiens
ILAVVTMAY

SEQ ID NO: 10278 - protein, 9 aa, Homo sapiens
ILAVVTMAY

SEQ ID NO: 10279 - protein, 9 aa, Homo sapiens
YMNLGPSTS

SEQ ID NO: 10280 - protein, 9 aa, Homo sapiens
VLYMDSWAR

SEQ ID NO: 10281 - protein, 9 aa, Homo sapiens
YRPQECKAL

SEQ ID NO: 10282 - protein, 9 aa, Homo sapiens
ASVNSCAVN

SEQ ID NO: 10283 - protein, 9 aa, Homo sapiens
NPDKRFTDL

SEQ ID NO: 10284 - protein, 9 aa, Homo sapiens
NASYDTINL

SEQ ID NO: 10285 - protein, 9 aa, Homo sapiens
SLELSNLYK

SEQ ID NO: 10286 - protein, 9 aa, Homo sapiens
ESLELSNLY

SEQ ID NO: 10287 - protein, 9 aa, Homo sapiens
QIYSWKKVI

SEQ ID NO: 10288 - protein, 9 aa, Homo sapiens
RALPRALFR

SEQ ID NO: 10289 - protein, 9 aa, Homo sapiens
RLRALPRAL

SEQ ID NO: 10290 - protein, 9 aa, Homo sapiens
LRRNRLRAL

SEQ ID NO: 10291 - protein, 9 aa, Homo sapiens
LRALPRALF

SEQ ID NO: 10292 - protein, 9 aa, Homo sapiens
VTHACSLIY

SEQ ID NO: 10293 - protein, 9 aa, Homo sapiens
LIYCVHFIL

SEQ ID NO: 10294 - protein, 9 aa, Homo sapiens
LPSRVGALH

SEQ ID NO: 10295 - protein, 9 aa, Homo sapiens
RVGALHGVL

SEQ ID NO: 10296 - protein, 9 aa, Homo sapiens
LMDFFQASK

SEQ ID NO: 10297 - protein, 9 aa, Homo sapiens
NVEELMDFF

SEQ ID NO: 10298 - protein, 9 aa, Homo sapiens
SPSSSLGSL

SEQ ID NO: 10299 - protein, 9 aa, Homo sapiens
QPVEASPSS

SEQ ID NO: 10300 - protein, 9 aa, Homo sapiens
MSGAGDSEY

SEQ ID NO: 10301 - protein, 9 aa, Homo sapiens
MSGAGDSEY

SEQ ID NO: 10302 - protein, 9 aa, Homo sapiens
RLLKRTPRP

SEQ ID NO: 10303 - protein, 9 aa, Homo sapiens
PASTHDSSL

SEQ ID NO: 10304 - protein, 9 aa, Homo sapiens
SLTKEELNK

SEQ ID NO: 10305 - protein, 9 aa, Homo sapiens
SREAYGRAL

SEQ ID NO: 10306 - protein, 9 aa, Homo sapiens
TPEMYQTML

SEQ ID NO: 10307 - protein, 9 aa, Homo sapiens
IQEFKPSNK

SEQ ID NO: 10308 - protein, 9 aa, Homo sapiens
AVFWIEFVM

SEQ ID NO: 10309 - protein, 9 aa, Homo sapiens
TVLASSATL

SEQ ID NO: 10310 - protein, 9 aa, Homo sapiens
RPNLHPSFI

SEQ ID NO: 10311 - protein, 9 aa, Homo sapiens
SHPPTVVRR

SEQ ID NO: 10312 - protein, 9 aa, Homo sapiens
LPDATPTEL

SEQ ID NO: 10313 - protein, 9 aa, Homo sapiens
LPDATPTEL

SEQ ID NO: 10314 - protein, 9 aa, Homo sapiens
TSTQHHFAF

SEQ ID NO: 10315 - protein, 9 aa, Homo sapiens
AFQNAERAF

SEQ ID NO: 10316 - protein, 9 aa, Homo sapiens
EPTQIPAPG

SEQ ID NO: 10317 - protein, 9 aa, Homo sapiens
NRTLGLIVF

SEQ ID NO: 10318 - protein, 9 aa, Homo sapiens
SSHARLSAD

SEQ ID NO: 10319 - protein, 9 aa, Homo sapiens
SSHARLSAD

SEQ ID NO: 10320 - protein, 9 aa, Homo sapiens
ARLSADATL

SEQ ID NO: 10321 - protein, 9 aa, Homo sapiens
LTDEASGAF

SEQ ID NO: 10322 - protein, 9 aa, Homo sapiens
LTDEASGAF

SEQ ID NO: 10323 - protein, 9 aa, Homo sapiens
RLRSLTAQI

SEQ ID NO: 10324 - protein, 9 aa, Homo sapiens
KIYIRLKRR

SEQ ID NO: 10325 - protein, 9 aa, Homo sapiens
KRRNNMMDK

SEQ ID NO: 10326 - protein, 9 aa, Homo sapiens
KIYIRLKRR

SEQ ID NO: 10327 - protein, 9 aa, Homo sapiens
KRRNNMMDK

SEQ ID NO: 10328 - protein, 9 aa, Homo sapiens
HILNLTKNK

SEQ ID NO: 10329 - protein, 9 aa, Homo sapiens
LAHSPLHIL

SEQ ID NO: 10330 - protein, 9 aa, Homo sapiens
PPRWWAGEW

SEQ ID NO: 10331 - protein, 9 aa, Homo sapiens
CPSEDVVIT

SEQ ID NO: 10332 - protein, 9 aa, Homo sapiens
VPFLWPGQM

SEQ ID NO: 10333 - protein, 9 aa, Homo sapiens
VPFLWPGQM

SEQ ID NO: 10334 - protein, 9 aa, Homo sapiens
AMADSDHLT

SEQ ID NO: 10335 - protein, 9 aa, Homo sapiens
FRCLCLPSY

SEQ ID NO: 10336 - protein, 9 aa, Homo sapiens
CLPSYVGAL

SEQ ID NO: 10337 - protein, 9 aa, Homo sapiens
TRKDKTKAL

SEQ ID NO: 10338 - protein, 9 aa, Homo sapiens
IGVIFSLSK

SEQ ID NO: 10339 - protein, 9 aa, Homo sapiens
RSSSPGKPQ

SEQ ID NO: 10340 - protein, 9 aa, Homo sapiens
AVRLCRRSR

SEQ ID NO: 10341 - protein, 9 aa, Homo sapiens
LSLLDDSKF

SEQ ID NO: 10342 - protein, 9 aa, Homo sapiens
SWDWAKPSF

SEQ ID NO: 10343 - protein, 9 aa, Homo sapiens
PPADTNQML

SEQ ID NO: 10344 - protein, 9 aa, Homo sapiens
QPPAKAFLY

SEQ ID NO: 10345 - protein, 9 aa, Homo sapiens
KAFGTCSSH

SEQ ID NO: 10346 - protein, 9 aa, Homo sapiens
FALELQKSF

SEQ ID NO: 10347 - protein, 9 aa, Homo sapiens
VQALSLWQK

SEQ ID NO: 10348 - protein, 9 aa, Homo sapiens
LALDHLHSL

SEQ ID NO: 10349 - protein, 9 aa, Homo sapiens
FADCAILLL

SEQ ID NO: 10350 - protein, 9 aa, Homo sapiens
HRFADCAIL

SEQ ID NO: 10351 - protein, 9 aa, Homo sapiens
LPDQSSPVP

SEQ ID NO: 10352 - protein, 9 aa, Homo sapiens
HPVITTQSA

SEQ ID NO: 10353 - protein, 9 aa, Homo sapiens
HPVITTQSA

SEQ ID NO: 10354 - protein, 9 aa, Homo sapiens
AERPALNVV

SEQ ID NO: 10355 - protein, 9 aa, Homo sapiens
SFQAERPAL

SEQ ID NO: 10356 - protein, 9 aa, Homo sapiens
LSYAFSVWR

SEQ ID NO: 10357 - protein, 9 aa, Homo sapiens
SYAFSVWRM

SEQ ID NO: 10358 - protein, 9 aa, Homo sapiens
VLNGTFSLN

SEQ ID NO: 10359 - protein, 9 aa, Homo sapiens
SVFLLTVPF

SEQ ID NO: 10360 - protein, 9 aa, Homo sapiens
CPNGRFSEK

SEQ ID NO: 10361 - protein, 9 aa, Homo sapiens
NAVCPNGRF

SEQ ID NO: 10362 - protein, 9 aa, Homo sapiens
HLLLFASIK

SEQ ID NO: 10363 - protein, 9 aa, Homo sapiens
DPYLQSWEM

SEQ ID NO: 10364 - protein, 9 aa, Homo sapiens
YLQSWEMYL

SEQ ID NO: 10365 - protein, 9 aa, Homo sapiens
YPQGSSWEH

SEQ ID NO: 10366 - protein, 9 aa, Homo sapiens
LVGAALFRK

SEQ ID NO: 10367 - protein, 9 aa, Homo sapiens
VSRLNGSSL

SEQ ID NO: 10368 - protein, 9 aa, Homo sapiens
AIVMYMAPK

SEQ ID NO: 10369 - protein, 9 aa, Homo sapiens
LFFGSAIVM

SEQ ID NO: 10370 - protein, 9 aa, Homo sapiens
FFGSAIVMY

SEQ ID NO: 10371 - protein, 9 aa, Homo sapiens
WASIIVKKY

SEQ ID NO: 10372 - protein, 9 aa, Homo sapiens
RLTNTFCAG

SEQ ID NO: 10373 - protein, 9 aa, Homo sapiens
LYTLRIVSR

SEQ ID NO: 10374 - protein, 9 aa, Homo sapiens
LPIGYGAHI

SEQ ID NO: 10375 - protein, 9 aa, Homo sapiens
RSSIGFLIH

SEQ ID NO: 10376 - protein, 9 aa, Homo sapiens
RSSIGFLIH

SEQ ID NO: 10377 - protein, 9 aa, Homo sapiens
KCLAQINSK

SEQ ID NO: 10378 - protein, 9 aa, Homo sapiens
SRKDSGSSS

SEQ ID NO: 10379 - protein, 9 aa, Homo sapiens
TLKSQKKRK

SEQ ID NO: 10380 - protein, 9 aa, Homo sapiens
TSWDTAELY

SEQ ID NO: 10381 - protein, 9 aa, Homo sapiens
TSWDTAELY

SEQ ID NO: 10382 - protein, 9 aa, Homo sapiens
WDTAELYPF

SEQ ID NO: 10383 - protein, 9 aa, Homo sapiens
TVKDFSHAK

SEQ ID NO: 10384 - protein, 9 aa, Homo sapiens
NLTYRDLYY

SEQ ID NO: 10385 - protein, 9 aa, Homo sapiens
VSYPDNLTY

SEQ ID NO: 10386 - protein, 9 aa, Homo sapiens
VSYPDNLTY

SEQ ID NO: 10387 - protein, 9 aa, Homo sapiens
TYRDLYYFL

SEQ ID NO: 10388 - protein, 9 aa, Homo sapiens
AVLGVPSSL

SEQ ID NO: 10389 - protein, 9 aa, Homo sapiens
VPSSLASSV

SEQ ID NO: 10390 - protein, 9 aa, Homo sapiens
VPAVLGVPS

SEQ ID NO: 10391 - protein, 9 aa, Homo sapiens
VPSSLASSV

SEQ ID NO: 10392 - protein, 9 aa, Homo sapiens
LPTATVPPV

SEQ ID NO: 10393 - protein, 9 aa, Homo sapiens
LPTATVPPV

SEQ ID NO: 10394 - protein, 9 aa, Homo sapiens
RADGAPRSV

SEQ ID NO: 10395 - protein, 9 aa, Homo sapiens
APRSVVPAW

SEQ ID NO: 10396 - protein, 9 aa, Homo sapiens
FLFLLCLIM

SEQ ID NO: 10397 - protein, 9 aa, Homo sapiens
TLLIKKGMK

SEQ ID NO: 10398 - protein, 9 aa, Homo sapiens
EFVGYTLVY

SEQ ID NO: 10399 - protein, 9 aa, Homo sapiens
YYKYSHPVF

SEQ ID NO: 10400 - protein, 9 aa, Homo sapiens
YKYSHPVFF

SEQ ID NO: 10401 - protein, 9 aa, Homo sapiens
SVQSFIGNL

SEQ ID NO: 10402 - protein, 9 aa, Homo sapiens
KPLSSLTPL

SEQ ID NO: 10403 - protein, 9 aa, Homo sapiens
KPLSSLTPL

SEQ ID NO: 10404 - protein, 9 aa, Homo sapiens
SPERTHSTF

SEQ ID NO: 10405 - protein, 9 aa, Homo sapiens
SPERTHSTF

SEQ ID NO: 10406 - protein, 9 aa, Homo sapiens
LPTTMNYPL

SEQ ID NO: 10407 - protein, 9 aa, Homo sapiens
LPTTMNYPL

SEQ ID NO: 10408 - protein, 9 aa, Homo sapiens
YTSLNVSCK

SEQ ID NO: 10409 - protein, 9 aa, Homo sapiens
AGPGSLLAW

SEQ ID NO: 10410 - protein, 9 aa, Homo sapiens
SLKIQPVEK

SEQ ID NO: 10411 - protein, 9 aa, Homo sapiens
SLSIKEASK

SEQ ID NO: 10412 - protein, 9 aa, Homo sapiens
KQRVIVMLY

SEQ ID NO: 10413 - protein, 9 aa, Homo sapiens
RVIVMLYNK

SEQ ID NO: 10414 - protein, 9 aa, Homo sapiens
EEWVQQLKF

SEQ ID NO: 10415 - protein, 9 aa, Homo sapiens
QTIRIHGLK

SEQ ID NO: 10416 - protein, 9 aa, Homo sapiens
RIHGLKSGK

SEQ ID NO: 10417 - protein, 9 aa, Homo sapiens
GLKSGKTLK

SEQ ID NO: 10418 - protein, 9 aa, Homo sapiens
ELVHCPALK

SEQ ID NO: 10419 - protein, 9 aa, Homo sapiens
KRTALSKVV

SEQ ID NO: 10420 - protein, 9 aa, Homo sapiens
DTSYVLTPH

SEQ ID NO: 10421 - protein, 9 aa, Homo sapiens
LRRAGGSSL

SEQ ID NO: 10422 - protein, 9 aa, Homo sapiens
KSFSKYASF

SEQ ID NO: 10423 - protein, 9 aa, Homo sapiens
ASFSNHQRV

SEQ ID NO: 10424 - protein, 9 aa, Homo sapiens
GWLDNASSF

SEQ ID NO: 10425 - protein, 9 aa, Homo sapiens
YAFPKEFPY

SEQ ID NO: 10426 - protein, 9 aa, Homo sapiens
AEIKNSLKI

SEQ ID NO: 10427 - protein, 9 aa, Homo sapiens
KVLQIGSAK

SEQ ID NO: 10428 - protein, 9 aa, Homo sapiens
TYTVVTPLL

SEQ ID NO: 10429 - protein, 9 aa, Homo sapiens
RYAAICHPL

SEQ ID NO: 10430 - protein, 9 aa, Homo sapiens
AAICHPLHY

SEQ ID NO: 10431 - protein, 9 aa, Homo sapiens
IPGLKATQY

SEQ ID NO: 10432 - protein, 9 aa, Homo sapiens
LSGPLCVMY

SEQ ID NO: 10433 - protein, 9 aa, Homo sapiens
TPTANANSF

SEQ ID NO: 10434 - protein, 9 aa, Homo sapiens
KFMTVFYTI

SEQ ID NO: 10435 - protein, 9 aa, Homo sapiens
FPTDKFMTV

SEQ ID NO: 10436 - protein, 9 aa, Homo sapiens
MTVFYTIIT

SEQ ID NO: 10437 - protein, 9 aa, Homo sapiens
EPDQLAQRL

SEQ ID NO: 10438 - protein, 9 aa, Homo sapiens
LAQEAALVA

SEQ ID NO: 10439 - protein, 9 aa, Homo sapiens
QQFFNGHPL

SEQ ID NO: 10440 - protein, 9 aa, Homo sapiens
ILAPAVGSY

SEQ ID NO: 10441 - protein, 9 aa, Homo sapiens
FPILAPAVG

SEQ ID NO: 10442 - protein, 9 aa, Homo sapiens
ILAPAVGSY

SEQ ID NO: 10443 - protein, 9 aa, Homo sapiens
RTHCDTNKK

SEQ ID NO: 10444 - protein, 9 aa, Homo sapiens
VIYFHQYTH

SEQ ID NO: 10445 - protein, 9 aa, Homo sapiens
FLLLCTVIY

SEQ ID NO: 10446 - protein, 9 aa, Homo sapiens
KLVTETAGK

SEQ ID NO: 10447 - protein, 9 aa, Homo sapiens
RVALEDVLK

SEQ ID NO: 10448 - protein, 9 aa, Homo sapiens
TAALRIGAF

SEQ ID NO: 10449 - protein, 9 aa, Homo sapiens
VVAAGGVEK

SEQ ID NO: 10450 - protein, 9 aa, Homo sapiens
SSAFQTLEK

SEQ ID NO: 10451 - protein, 9 aa, Homo sapiens
VYSSAFQTL

SEQ ID NO: 10452 - protein, 9 aa, Homo sapiens
SAFQTLEKY

SEQ ID NO: 10453 - protein, 9 aa, Homo sapiens
RMKTCLLMR

SEQ ID NO: 10454 - protein, 9 aa, Homo sapiens
FALWLKDCH

SEQ ID NO: 10455 - protein, 9 aa, Homo sapiens
WLKDCHEKY

SEQ ID NO: 10456 - protein, 9 aa, Homo sapiens
NAHGEENGV

SEQ ID NO: 10457 - protein, 9 aa, Homo sapiens
QQYAGPAAY

SEQ ID NO: 10458 - protein, 9 aa, Homo sapiens
CVWVPKLAF

SEQ ID NO: 10459 - protein, 9 aa, Homo sapiens
VPKLAFVLF

SEQ ID NO: 10460 - protein, 9 aa, Homo sapiens
RTHRSLFKH

SEQ ID NO: 10461 - protein, 9 aa, Homo sapiens
GPEKRKVAY

SEQ ID NO: 10462 - protein, 9 aa, Homo sapiens
CTNAVSDMM

SEQ ID NO: 10463 - protein, 9 aa, Homo sapiens
LALKKPMAK

SEQ ID NO: 10464 - protein, 9 aa, Homo sapiens
CVNKEELAL

SEQ ID NO: 10465 - protein, 9 aa, Homo sapiens
AWATSISIF

SEQ ID NO: 10466 - protein, 9 aa, Homo sapiens
YGASLAWAT

SEQ ID NO: 10467 - protein, 9 aa, Homo sapiens
LAWATSISI

SEQ ID NO: 10468 - protein, 9 aa, Homo sapiens
VPEQTEYAT

SEQ ID NO: 10469 - protein, 9 aa, Homo sapiens
QTEYATIVF

SEQ ID NO: 10470 - protein, 9 aa, Homo sapiens
TSYSRWARL

SEQ ID NO: 10471 - protein, 9 aa, Homo sapiens
NSCYLSSVM

SEQ ID NO: 10472 - protein, 9 aa, Homo sapiens
SPSSASTGH

SEQ ID NO: 10473 - protein, 9 aa, Homo sapiens
NPNACGSAS

SEQ ID NO: 10474 - protein, 9 aa, Homo sapiens
NACGSASCY

SEQ ID NO: 10475 - protein, 9 aa, Homo sapiens
PISTYSLKK

SEQ ID NO: 10476 - protein, 9 aa, Homo sapiens
TTTGHLIYK

SEQ ID NO: 10477 - protein, 9 aa, Homo sapiens
SSVQKLVLY

SEQ ID NO: 10478 - protein, 9 aa, Homo sapiens
VLYETRARY

SEQ ID NO: 10479 - protein, 9 aa, Homo sapiens
SVRMLSGSK

SEQ ID NO: 10480 - protein, 9 aa, Homo sapiens
RMLSGSKEK

SEQ ID NO: 10481 - protein, 9 aa, Homo sapiens
QLRVIFAGK

SEQ ID NO: 10482 - protein, 9 aa, Homo sapiens
CPVDGCLSN

SEQ ID NO: 10483 - protein, 9 aa, Homo sapiens
EVTCSPCEM

SEQ ID NO: 10484 - protein, 9 aa, Homo sapiens
IFRITNNGK

SEQ ID NO: 10485 - protein, 9 aa, Homo sapiens
QLLRRACAR

SEQ ID NO: 10486 - protein, 9 aa, Homo sapiens
ISQAAVPAR

SEQ ID NO: 10487 - protein, 9 aa, Homo sapiens
TLGHLPVIR

SEQ ID NO: 10488 - protein, 9 aa, Homo sapiens
HRMERMEQM

SEQ ID NO: 10489 - protein, 9 aa, Homo sapiens
ERMEQMYTL

SEQ ID NO: 10490 - protein, 9 aa, Homo sapiens
AHRMERMEQ

SEQ ID NO: 10491 - protein, 9 aa, Homo sapiens
HRMERMEQM

SEQ ID NO: 10492 - protein, 9 aa, Homo sapiens
ERMEQMYTL

SEQ ID NO: 10493 - protein, 9 aa, Homo sapiens
VLDDFKRFK

SEQ ID NO: 10494 - protein, 9 aa, Homo sapiens
KLALLEEAR

SEQ ID NO: 10495 - protein, 9 aa, Homo sapiens
APNRDQWSM

SEQ ID NO: 10496 - protein, 9 aa, Homo sapiens
DQWSMTPPM

SEQ ID NO: 10497 - protein, 9 aa, Homo sapiens
VVIRQERAG

SEQ ID NO: 10498 - protein, 9 aa, Homo sapiens
IRQERAGQT

SEQ ID NO: 10499 - protein, 9 aa, Homo sapiens
AGQTSVSLL

SEQ ID NO: 10500 - protein, 9 aa, Homo sapiens
QPYGRSPSA

SEQ ID NO: 10501 - protein, 9 aa, Homo sapiens
FPQGYGFGS

SEQ ID NO: 10502 - protein, 9 aa, Homo sapiens
RALREAYIR

SEQ ID NO: 10503 - protein, 9 aa, Homo sapiens
IRALREAYI

SEQ ID NO: 10504 - protein, 9 aa, Homo sapiens
FIASAMAVE

SEQ ID NO: 10505 - protein, 9 aa, Homo sapiens
IASAMAVER

SEQ ID NO: 10506 - protein, 9 aa, Homo sapiens
AVERALAIR

SEQ ID NO: 10507 - protein, 9 aa, Homo sapiens
MAVERALAI

SEQ ID NO: 10508 - protein, 9 aa, Homo sapiens
VPNASVDVG

SEQ ID NO: 10509 - protein, 9 aa, Homo sapiens
IVVEFILTH

SEQ ID NO: 10510 - protein, 9 aa, Homo sapiens
KQPSPEEIR

SEQ ID NO: 10511 - protein, 9 aa, Homo sapiens
PAPCATSNY

SEQ ID NO: 10512 - protein, 9 aa, Homo sapiens
MACHGSSSF

SEQ ID NO: 10513 - protein, 9 aa, Homo sapiens
MACHGSSSF

SEQ ID NO: 10514 - protein, 9 aa, Homo sapiens
PAMRLFGYK

SEQ ID NO: 10515 - protein, 9 aa, Homo sapiens
PAMRLFGYK

SEQ ID NO: 10516 - protein, 9 aa, Homo sapiens
GPAMRLFGY

SEQ ID NO: 10517 - protein, 9 aa, Homo sapiens
QSANESKNE

SEQ ID NO: 10518 - protein, 9 aa, Homo sapiens
LEKSRIRLR

SEQ ID NO: 10519 - protein, 9 aa, Homo sapiens
RIRLRRTLR

SEQ ID NO: 10520 - protein, 9 aa, Homo sapiens
SRIRLRRTL

SEQ ID NO: 10521 - protein, 9 aa, Homo sapiens
LRGPSPSSV

SEQ ID NO: 10522 - protein, 9 aa, Homo sapiens
RAPAEQVPR

SEQ ID NO: 10523 - protein, 9 aa, Homo sapiens
PVYTRQAPK

SEQ ID NO: 10524 - protein, 9 aa, Homo sapiens
AELNTFYLK

SEQ ID NO: 10525 - protein, 9 aa, Homo sapiens
LLAELNTFY

SEQ ID NO: 10526 - protein, 9 aa, Homo sapiens
TPTATSFTA

SEQ ID NO: 10527 - protein, 9 aa, Homo sapiens
TPTATSFTA

SEQ ID NO: 10528 - protein, 9 aa, Homo sapiens
TPTATSFTA

SEQ ID NO: 10529 - protein, 9 aa, Homo sapiens
TPTATSFTA

SEQ ID NO: 10530 - protein, 9 aa, Homo sapiens
TATTPTATS

SEQ ID NO: 10531 - protein, 9 aa, Homo sapiens
TPTATSFTA

SEQ ID NO: 10532 - protein, 9 aa, Homo sapiens
TPTATSFTA

SEQ ID NO: 10533 - protein, 9 aa, Homo sapiens
TPTATSFTA

SEQ ID NO: 10534 - protein, 9 aa, Homo sapiens
FTAIPSSSL

SEQ ID NO: 10535 - protein, 9 aa, Homo sapiens
TATTPTATS

SEQ ID NO: 10536 - protein, 9 aa, Homo sapiens
TPTATSFTA

SEQ ID NO: 10537 - protein, 9 aa, Homo sapiens
TPTATSFTA

SEQ ID NO: 10538 - protein, 9 aa, Homo sapiens
PVFLAPAFH

SEQ ID NO: 10539 - protein, 9 aa, Homo sapiens
DPVFLAPAF

SEQ ID NO: 10540 - protein, 9 aa, Homo sapiens
RSRGRPRFL

SEQ ID NO: 10541 - protein, 9 aa, Homo sapiens
MGVAGMPPF

SEQ ID NO: 10542 - protein, 9 aa, Homo sapiens
LPSSRPAQL

SEQ ID NO: 10543 - protein, 9 aa, Homo sapiens
RLRRRPADR

SEQ ID NO: 10544 - protein, 9 aa, Homo sapiens
ESFLFKIDK

SEQ ID NO: 10545 - protein, 9 aa, Homo sapiens
LFKIDKSYR

SEQ ID NO: 10546 - protein, 9 aa, Homo sapiens
FLFKIDKSY

SEQ ID NO: 10547 - protein, 9 aa, Homo sapiens
SRVEMVNGV

SEQ ID NO: 10548 - protein, 9 aa, Homo sapiens
KFFLCQVAG

SEQ ID NO: 10549 - protein, 9 aa, Homo sapiens
STCGKQFKR

SEQ ID NO: 10550 - protein, 9 aa, Homo sapiens
STCGKQFKR

SEQ ID NO: 10551 - protein, 9 aa, Homo sapiens
QFKRKDKLR

SEQ ID NO: 10552 - protein, 9 aa, Homo sapiens
GTEGEFFAK

SEQ ID NO: 10553 - protein, 9 aa, Homo sapiens
GTEGEFFAK

SEQ ID NO: 10554 - protein, 9 aa, Homo sapiens
KLMDEPALR

SEQ ID NO: 10555 - protein, 9 aa, Homo sapiens
KLMDEPALR

SEQ ID NO: 10556 - protein, 9 aa, Homo sapiens
SPVTLGTSL

SEQ ID NO: 10557 - protein, 9 aa, Homo sapiens
LRGPLPRLL

SEQ ID NO: 10558 - protein, 9 aa, Homo sapiens
HPYQGEPPS

SEQ ID NO: 10559 - protein, 9 aa, Homo sapiens
HWYSRLLYR

SEQ ID NO: 10560 - protein, 9 aa, Homo sapiens
MHWYSRLLY

SEQ ID NO: 10561 - protein, 9 aa, Homo sapiens
AVQLRWGPR

SEQ ID NO: 10562 - protein, 9 aa, Homo sapiens
IANVAHTFV

SEQ ID NO: 10563 - protein, 9 aa, Homo sapiens
VDVAQGTQV

SEQ ID NO: 10564 - protein, 9 aa, Homo sapiens
SLCLSLCLC

SEQ ID NO: 10565 - protein, 9 aa, Homo sapiens
SLCLSLCLC

SEQ ID NO: 10566 - protein, 9 aa, Homo sapiens
YRLTPSFEY

SEQ ID NO: 10567 - protein, 9 aa, Homo sapiens
FHQEMLNYR

SEQ ID NO: 10568 - protein, 9 aa, Homo sapiens
AKCRQWLEK

SEQ ID NO: 10569 - protein, 9 aa, Homo sapiens
AQRYIAQLK

SEQ ID NO: 10570 - protein, 9 aa, Homo sapiens
ASIWDTFTH

SEQ ID NO: 10571 - protein, 9 aa, Homo sapiens
SIWDTFTHH

SEQ ID NO: 10572 - protein, 9 aa, Homo sapiens
APYLVPIEL

SEQ ID NO: 10573 - protein, 9 aa, Homo sapiens
NRDGSASLL

SEQ ID NO: 10574 - protein, 9 aa, Homo sapiens
HCWDYRRFV

SEQ ID NO: 10575 - protein, 9 aa, Homo sapiens
MSSANVYLE

SEQ ID NO: 10576 - protein, 9 aa, Homo sapiens
SANVYLESK

SEQ ID NO: 10577 - protein, 9 aa, Homo sapiens
MSSANVYLE

SEQ ID NO: 10578 - protein, 9 aa, Homo sapiens
TPDLSRHLY

SEQ ID NO: 10579 - protein, 9 aa, Homo sapiens
CPARTLRVL

SEQ ID NO: 10580 - protein, 9 aa, Homo sapiens
RGPEWSAAR

SEQ ID NO: 10581 - protein, 9 aa, Homo sapiens
WSAARRASR

SEQ ID NO: 10582 - protein, 9 aa, Homo sapiens
ARRASREAV

SEQ ID NO: 10583 - protein, 9 aa, Homo sapiens
YKRKRRQSV

SEQ ID NO: 10584 - protein, 9 aa, Homo sapiens
KRRQSVGDF

SEQ ID NO: 10585 - protein, 9 aa, Homo sapiens
TEMEQELLL

SEQ ID NO: 10586 - protein, 9 aa, Homo sapiens
RICPPGFYG

SEQ ID NO: 10587 - protein, 9 aa, Homo sapiens
MDERRYTPR

SEQ ID NO: 10588 - protein, 9 aa, Homo sapiens
NATMDERRY

SEQ ID NO: 10589 - protein, 9 aa, Homo sapiens
GTAPCPTWK

SEQ ID NO: 10590 - protein, 9 aa, Homo sapiens
HPFRARITY

SEQ ID NO: 10591 - protein, 9 aa, Homo sapiens
FRNRPHPFR

SEQ ID NO: 10592 - protein, 9 aa, Homo sapiens
HPFRARITY

SEQ ID NO: 10593 - protein, 9 aa, Homo sapiens
RLRELERLR

SEQ ID NO: 10594 - protein, 9 aa, Homo sapiens
VYEQFLAPG

SEQ ID NO: 10595 - protein, 9 aa, Homo sapiens
SGAVDSTVK

SEQ ID NO: 10596 - protein, 9 aa, Homo sapiens
KTESMFMAG

SEQ ID NO: 10597 - protein, 9 aa, Homo sapiens
KTESMFMAG

SEQ ID NO: 10598 - protein, 9 aa, Homo sapiens
FRGNSYPGA

SEQ ID NO: 10599 - protein, 9 aa, Homo sapiens
LLWFCGMSR

SEQ ID NO: 10600 - protein, 9 aa, Homo sapiens
LLWFCGMSR

SEQ ID NO: 10601 - protein, 9 aa, Homo sapiens
KGKGLMTAR

SEQ ID NO: 10602 - protein, 9 aa, Homo sapiens
LMTARGGNR

SEQ ID NO: 10603 - protein, 9 aa, Homo sapiens
MTARGGNRR

SEQ ID NO: 10604 - protein, 9 aa, Homo sapiens
YPAYAGGGG

SEQ ID NO: 10605 - protein, 9 aa, Homo sapiens
YAGGGGFVL

SEQ ID NO: 10606 - protein, 9 aa, Homo sapiens
TAGAPDPAW

SEQ ID NO: 10607 - protein, 9 aa, Homo sapiens
ASPDPTPGR

SEQ ID NO: 10608 - protein, 9 aa, Homo sapiens
ASPDPTPGR

SEQ ID NO: 10609 - protein, 9 aa, Homo sapiens
SSEASETCQ

SEQ ID NO: 10610 - protein, 9 aa, Homo sapiens
IAVASSDPA

SEQ ID NO: 10611 - protein, 9 aa, Homo sapiens
VASSDPAAA

SEQ ID NO: 10612 - protein, 9 aa, Homo sapiens
EPTSEPAPS

SEQ ID NO: 10613 - protein, 9 aa, Homo sapiens
EPTSEPAPS

SEQ ID NO: 10614 - protein, 9 aa, Homo sapiens
SYSPTSPSY

SEQ ID NO: 10615 - protein, 9 aa, Homo sapiens
KSSGAGPSR

SEQ ID NO: 10616 - protein, 9 aa, Homo sapiens
KSSGAGPSR

SEQ ID NO: 10617 - protein, 9 aa, Homo sapiens
DENEDDSEL

SEQ ID NO: 10618 - protein, 9 aa, Homo sapiens
FNYYTTSAM

SEQ ID NO: 10619 - protein, 9 aa, Homo sapiens
YYQVLIDAR

SEQ ID NO: 10620 - protein, 9 aa, Homo sapiens
EVSGKGPAV

SEQ ID NO: 10621 - protein, 9 aa, Homo sapiens
RFRSVTHAY

SEQ ID NO: 10622 - protein, 9 aa, Homo sapiens
LPFAEEGNL

SEQ ID NO: 10623 - protein, 9 aa, Homo sapiens
FAEEGNLTI

SEQ ID NO: 10624 - protein, 9 aa, Homo sapiens
RSSPCPNVK

SEQ ID NO: 10625 - protein, 9 aa, Homo sapiens
YRSSPCPNV

SEQ ID NO: 10626 - protein, 9 aa, Homo sapiens
RRNAKEERV

SEQ ID NO: 10627 - protein, 9 aa, Homo sapiens
GSCSRDRDR

SEQ ID NO: 10628 - protein, 9 aa, Homo sapiens
GPASLRAEY

SEQ ID NO: 10629 - protein, 9 aa, Homo sapiens
VLNSLAEEK

SEQ ID NO: 10630 - protein, 9 aa, Homo sapiens
PRIPILHFR

SEQ ID NO: 10631 - protein, 9 aa, Homo sapiens
VTSRKNQEL

SEQ ID NO: 10632 - protein, 9 aa, Homo sapiens
SRKNQELAF

SEQ ID NO: 10633 - protein, 9 aa, Homo sapiens
LVQYYDDEK

SEQ ID NO: 10634 - protein, 9 aa, Homo sapiens
QLLSPECWK

SEQ ID NO: 10635 - protein, 9 aa, Homo sapiens
LLMQSSAEQ

SEQ ID NO: 10636 - protein, 9 aa, Homo sapiens
QLLSPECWK

SEQ ID NO: 10637 - protein, 9 aa, Homo sapiens
MQSSAEQLL

SEQ ID NO: 10638 - protein, 9 aa, Homo sapiens
QPQQLAPDF

SEQ ID NO: 10639 - protein, 9 aa, Homo sapiens
LAPDFPLAH

SEQ ID NO: 10640 - protein, 9 aa, Homo sapiens
KLPFHFDPK

SEQ ID NO: 10641 - protein, 9 aa, Homo sapiens
FHFDPKRAV

SEQ ID NO: 10642 - protein, 9 aa, Homo sapiens
SPVQVPGPV

SEQ ID NO: 10643 - protein, 9 aa, Homo sapiens
GPVAASTEA

SEQ ID NO: 10644 - protein, 9 aa, Homo sapiens
PPALAPGSL

SEQ ID NO: 10645 - protein, 9 aa, Homo sapiens
VWAAIGEAR

SEQ ID NO: 10646 - protein, 9 aa, Homo sapiens
FVVEVWAAI

SEQ ID NO: 10647 - protein, 9 aa, Homo sapiens
ATLSKDPRR

SEQ ID NO: 10648 - protein, 9 aa, Homo sapiens
STGLTGAVK

SEQ ID NO: 10649 - protein, 9 aa, Homo sapiens
LTGAVKLAK

SEQ ID NO: 10650 - protein, 9 aa, Homo sapiens
STGLTGAVK

SEQ ID NO: 10651 - protein, 9 aa, Homo sapiens
LTGAVKLAK

SEQ ID NO: 10652 - protein, 9 aa, Homo sapiens
STGLTGAVK

SEQ ID NO: 10653 - protein, 9 aa, Homo sapiens
YSPNRNEPL

SEQ ID NO: 10654 - protein, 9 aa, Homo sapiens
VSHMTSDRR

SEQ ID NO: 10655 - protein, 9 aa, Homo sapiens
MTSDRRQWC

SEQ ID NO: 10656 - protein, 9 aa, Homo sapiens
RYVNRMTNE

SEQ ID NO: 10657 - protein, 9 aa, Homo sapiens
TSGRCYHLR

SEQ ID NO: 10658 - protein, 9 aa, Homo sapiens
TSGRCYHLR

SEQ ID NO: 10659 - protein, 9 aa, Homo sapiens
RCYHLRHKV

SEQ ID NO: 10660 - protein, 9 aa, Homo sapiens
HQQKPIEPR

SEQ ID NO: 10661 - protein, 9 aa, Homo sapiens
QQKPIEPRR

SEQ ID NO: 10662 - protein, 9 aa, Homo sapiens
YSSTLTAHK

SEQ ID NO: 10663 - protein, 9 aa, Homo sapiens
SSTLTAHKR

SEQ ID NO: 10664 - protein, 9 aa, Homo sapiens
SSTLTAHKR

SEQ ID NO: 10665 - protein, 9 aa, Homo sapiens
IIHSGEKPY

SEQ ID NO: 10666 - protein, 9 aa, Homo sapiens
CSSNLTTHK

SEQ ID NO: 10667 - protein, 9 aa, Homo sapiens
SSNLTTHKK

SEQ ID NO: 10668 - protein, 9 aa, Homo sapiens
SSNLTTHKK

SEQ ID NO: 10669 - protein, 9 aa, Homo sapiens
ITRSGDRDR

SEQ ID NO: 10670 - protein, 9 aa, Homo sapiens
RSSHLTKHK

SEQ ID NO: 10671 - protein, 9 aa, Homo sapiens
SSHLTKHKR

SEQ ID NO: 10672 - protein, 9 aa, Homo sapiens
RSSHLTKHK

SEQ ID NO: 10673 - protein, 9 aa, Homo sapiens
SSHLTKHKR

SEQ ID NO: 10674 - protein, 9 aa, Homo sapiens
TKHKRIHTR

SEQ ID NO: 10675 - protein, 9 aa, Homo sapiens
GSSNFNAHK

SEQ ID NO: 10676 - protein, 9 aa, Homo sapiens
GSSNFNAHK

SEQ ID NO: 10677 - protein, 9 aa, Homo sapiens
GSSNFNAHK

SEQ ID NO: 10678 - protein, 9 aa, Homo sapiens
GSSNFNAHK

SEQ ID NO: 10679 - protein, 9 aa, Homo sapiens
GSSNFNAHK

SEQ ID NO: 10680 - protein, 9 aa, Homo sapiens
VIHTAEKPY

SEQ ID NO: 10681 - protein, 9 aa, Homo sapiens
EVCSKAFSR

SEQ ID NO: 10682 - protein, 9 aa, Homo sapiens
ECGKSFTFR

SEQ ID NO: 10683 - protein, 9 aa, Homo sapiens
NLKKTKLPK

SEQ ID NO: 10684 - protein, 9 aa, Homo sapiens
NLKKTKLPK

SEQ ID NO: 10685 - protein, 9 aa, Homo sapiens
DIFEINLPK

SEQ ID NO: 10686 - protein, 9 aa, Homo sapiens
RMEDAHCTW

SEQ ID NO: 10687 - protein, 9 aa, Homo sapiens
MEDAHCTWL

SEQ ID NO: 10688 - protein, 9 aa, Homo sapiens
AASGVLAAV

SEQ ID NO: 10689 - protein, 9 aa, Homo sapiens
VAAGANPAA

SEQ ID NO: 10690 - protein, 9 aa, Homo sapiens
VPIQEGQSL

SEQ ID NO: 10691 - protein, 9 aa, Homo sapiens
RNSHLVRHR

SEQ ID NO: 10692 - protein, 9 aa, Homo sapiens
RFCAKPFRR

SEQ ID NO: 10693 - protein, 9 aa, Homo sapiens
ALFTRTKLL

SEQ ID NO: 10694 - protein, 9 aa, Homo sapiens
ASTPETRAK

SEQ ID NO: 10695 - protein, 9 aa, Homo sapiens
FKVENTGQL

SEQ ID NO: 10696 - protein, 9 aa, Homo sapiens
PTSDLLLQK

SEQ ID NO: 10697 - protein, 9 aa, Homo sapiens
LLLQKLHSR

SEQ ID NO: 10698 - protein, 9 aa, Homo sapiens
LQKLHSRLL

SEQ ID NO: 10699 - protein, 9 aa, Homo sapiens
VADEMGLGK

SEQ ID NO: 10700 - protein, 9 aa, Homo sapiens
VPAASEEIF

SEQ ID NO: 10701 - protein, 9 aa, Homo sapiens
PPAPRPPAY

SEQ ID NO: 10702 - protein, 9 aa, Homo sapiens
AAHSARPER

SEQ ID NO: 10703 - protein, 9 aa, Homo sapiens
SRRTRCEDL

SEQ ID NO: 10704 - protein, 9 aa, Homo sapiens
TRCEDLDEL

SEQ ID NO: 10705 - protein, 9 aa, Homo sapiens
TVNSDCLDK

SEQ ID NO: 10706 - protein, 9 aa, Homo sapiens
LARWEDTPL

SEQ ID NO: 10707 - protein, 9 aa, Homo sapiens
AVNPVLYPL

SEQ ID NO: 10708 - protein, 9 aa, Homo sapiens
YPLCHHSFR

SEQ ID NO: 10709 - protein, 9 aa, Homo sapiens
PLCHHSFRR

SEQ ID NO: 10710 - protein, 9 aa, Homo sapiens
NPVLYPLCH

SEQ ID NO: 10711 - protein, 9 aa, Homo sapiens
MVSQSFTQR

SEQ ID NO: 10712 - protein, 9 aa, Homo sapiens
MVSQSFTQR

SEQ ID NO: 10713 - protein, 9 aa, Homo sapiens
ARSLSVQHM

SEQ ID NO: 10714 - protein, 9 aa, Homo sapiens
ILRMIRMDR

SEQ ID NO: 10715 - protein, 9 aa, Homo sapiens
RTPSGRVRR

SEQ ID NO: 10716 - protein, 9 aa, Homo sapiens
RTPSGRVRR

SEQ ID NO: 10717 - protein, 9 aa, Homo sapiens
RVSFSTLNY

SEQ ID NO: 10718 - protein, 9 aa, Homo sapiens
MNVDFDAPL

SEQ ID NO: 10719 - protein, 9 aa, Homo sapiens
TSANITWVY

SEQ ID NO: 10720 - protein, 9 aa, Homo sapiens
TSANITWVY

SEQ ID NO: 10721 - protein, 9 aa, Homo sapiens
YRRDVHQVA

SEQ ID NO: 10722 - protein, 9 aa, Homo sapiens
FGGAADNTL

SEQ ID NO: 10723 - protein, 9 aa, Homo sapiens
LVPGGGAAK

SEQ ID NO: 10724 - protein, 9 aa, Homo sapiens
WREPEVLDL

SEQ ID NO: 10725 - protein, 9 aa, Homo sapiens
HQEALRFLQ

SEQ ID NO: 10726 - protein, 9 aa, Homo sapiens
HQEALRFLQ

SEQ ID NO: 10727 - protein, 9 aa, Homo sapiens
RFLQKNSSK

SEQ ID NO: 10728 - protein, 9 aa, Homo sapiens
LTSCLQPLR

SEQ ID NO: 10729 - protein, 9 aa, Homo sapiens
PLRFCCDFR

SEQ ID NO: 10730 - protein, 9 aa, Homo sapiens
QPLRFCCDF

SEQ ID NO: 10731 - protein, 9 aa, Homo sapiens
LSPAHSPAK

SEQ ID NO: 10732 - protein, 9 aa, Homo sapiens
SPAKQPLGK

SEQ ID NO: 10733 - protein, 9 aa, Homo sapiens
PGSWTFQYR

SEQ ID NO: 10734 - protein, 9 aa, Homo sapiens
VPGSWTFQY

SEQ ID NO: 10735 - protein, 9 aa, Homo sapiens
FQYREDPVV

SEQ ID NO: 10736 - protein, 9 aa, Homo sapiens
QYREDPVVL

SEQ ID NO: 10737 - protein, 9 aa, Homo sapiens
YRPRKNPLF

SEQ ID NO: 10738 - protein, 9 aa, Homo sapiens
CLVDEEEMK

SEQ ID NO: 10739 - protein, 9 aa, Homo sapiens
WVCDRSYKR

SEQ ID NO: 10740 - protein, 9 aa, Homo sapiens
VNSHSLFVW

SEQ ID NO: 10741 - protein, 9 aa, Homo sapiens
SLFVWVCDR

SEQ ID NO: 10742 - protein, 9 aa, Homo sapiens
WVCDRSYKR

SEQ ID NO: 10743 - protein, 9 aa, Homo sapiens
FVWVCDRSY

SEQ ID NO: 10744 - protein, 9 aa, Homo sapiens
LVGLATAAF

SEQ ID NO: 10745 - protein, 9 aa, Homo sapiens
PPILVVLAS

SEQ ID NO: 10746 - protein, 9 aa, Homo sapiens
FCLPSFKSH

SEQ ID NO: 10747 - protein, 9 aa, Homo sapiens
HARPELPER

SEQ ID NO: 10748 - protein, 9 aa, Homo sapiens
VQKIREEER

SEQ ID NO: 10749 - protein, 9 aa, Homo sapiens
FPSDLAELR

SEQ ID NO: 10750 - protein, 9 aa, Homo sapiens
TPLHVTDAS

SEQ ID NO: 10751 - protein, 9 aa, Homo sapiens
LPVTSLSSA

SEQ ID NO: 10752 - protein, 9 aa, Homo sapiens
STGDTTPLH

SEQ ID NO: 10753 - protein, 9 aa, Homo sapiens
TPLHVTDAS

SEQ ID NO: 10754 - protein, 9 aa, Homo sapiens
LPVTSTSSA

SEQ ID NO: 10755 - protein, 9 aa, Homo sapiens
TPLPVTSPS

SEQ ID NO: 10756 - protein, 9 aa, Homo sapiens
LPVTSPSSV

SEQ ID NO: 10757 - protein, 9 aa, Homo sapiens
GLVYARIYR

SEQ ID NO: 10758 - protein, 9 aa, Homo sapiens
MGLVYARIY

SEQ ID NO: 10759 - protein, 9 aa, Homo sapiens
TLTLHNSAK

SEQ ID NO: 10760 - protein, 9 aa, Homo sapiens
LHNSAKVLI

SEQ ID NO: 10761 - protein, 9 aa, Homo sapiens
MLPARLPFR

SEQ ID NO: 10762 - protein, 9 aa, Homo sapiens
LPARLPFRL

SEQ ID NO: 10763 - protein, 9 aa, Homo sapiens
EVYPTSLTK

SEQ ID NO: 10764 - protein, 9 aa, Homo sapiens
RVSLMRPQE

SEQ ID NO: 10765 - protein, 9 aa, Homo sapiens
RVSLMRPQE

SEQ ID NO: 10766 - protein, 9 aa, Homo sapiens
SFVIAVLAE

SEQ ID NO: 10767 - protein, 9 aa, Homo sapiens
LQRVLLLFR

SEQ ID NO: 10768 - protein, 9 aa, Homo sapiens
LQRVLLLFR

SEQ ID NO: 10769 - protein, 9 aa, Homo sapiens
LFMAQQEQR

SEQ ID NO: 10770 - protein, 9 aa, Homo sapiens
AQQEQRRLR

SEQ ID NO: 10771 - protein, 9 aa, Homo sapiens
RLSIQSSPK

SEQ ID NO: 10772 - protein, 9 aa, Homo sapiens
RLSIQSSPK

SEQ ID NO: 10773 - protein, 9 aa, Homo sapiens
SPKCIVGKF

SEQ ID NO: 10774 - protein, 9 aa, Homo sapiens
RPSGCDAPY

SEQ ID NO: 10775 - protein, 9 aa, Homo sapiens
ITQVCHPHR

SEQ ID NO: 10776 - protein, 9 aa, Homo sapiens
ITQVCHPHR

SEQ ID NO: 10777 - protein, 9 aa, Homo sapiens
APFLASAVS

SEQ ID NO: 10778 - protein, 9 aa, Homo sapiens
SAVSAQPPL

SEQ ID NO: 10779 - protein, 9 aa, Homo sapiens
SAVSAQPPL

SEQ ID NO: 10780 - protein, 9 aa, Homo sapiens
RPIKKNSLY

SEQ ID NO: 10781 - protein, 9 aa, Homo sapiens
SLYSTDFIV

SEQ ID NO: 10782 - protein, 9 aa, Homo sapiens
VTKDPSSLK

SEQ ID NO: 10783 - protein, 9 aa, Homo sapiens
VTKDPSSLK

SEQ ID NO: 10784 - protein, 9 aa, Homo sapiens
GSGGSGAGK

SEQ ID NO: 10785 - protein, 9 aa, Homo sapiens
FGFSPTGAM

SEQ ID NO: 10786 - protein, 9 aa, Homo sapiens
GAMASADIV

SEQ ID NO: 10787 - protein, 9 aa, Homo sapiens
HPISNNNSL

SEQ ID NO: 10788 - protein, 9 aa, Homo sapiens
LYALVLLSR

SEQ ID NO: 10789 - protein, 9 aa, Homo sapiens
LLSSMLSRT

SEQ ID NO: 10790 - protein, 9 aa, Homo sapiens
SMLSRTLSY

SEQ ID NO: 10791 - protein, 9 aa, Homo sapiens
MLSRTLSYK

SEQ ID NO: 10792 - protein, 9 aa, Homo sapiens
MLSRTLSYK

SEQ ID NO: 10793 - protein, 9 aa, Homo sapiens
SSKTITSKK

SEQ ID NO: 10794 - protein, 9 aa, Homo sapiens
SSKTITSKK

SEQ ID NO: 10795 - protein, 9 aa, Homo sapiens
SPSSKTITS

SEQ ID NO: 10796 - protein, 9 aa, Homo sapiens
SAVNPSYNG

SEQ ID NO: 10797 - protein, 9 aa, Homo sapiens
PSYNGGEPK

SEQ ID NO: 10798 - protein, 9 aa, Homo sapiens
SAVNPSYNG

SEQ ID NO: 10799 - protein, 9 aa, Homo sapiens
SYNGGEPKR

SEQ ID NO: 10800 - protein, 9 aa, Homo sapiens
LPPAADLPY

SEQ ID NO: 10801 - protein, 9 aa, Homo sapiens
TASQSGSEI

SEQ ID NO: 10802 - protein, 9 aa, Homo sapiens
MSHSQHSPY

SEQ ID NO: 10803 - protein, 9 aa, Homo sapiens
SHSQHSPYL

SEQ ID NO: 10804 - protein, 9 aa, Homo sapiens
QHSPYLQSY

SEQ ID NO: 10805 - protein, 9 aa, Homo sapiens
LPLGLEEPY

SEQ ID NO: 10806 - protein, 9 aa, Homo sapiens
RRGGGGTEL

SEQ ID NO: 10807 - protein, 9 aa, Homo sapiens
LVLFPYGAQ

SEQ ID NO: 10808 - protein, 9 aa, Homo sapiens
FPYGAQGNW

SEQ ID NO: 10809 - protein, 9 aa, Homo sapiens
FYQRCPETL

SEQ ID NO: 10810 - protein, 9 aa, Homo sapiens
TALYSSVPF

SEQ ID NO: 10811 - protein, 9 aa, Homo sapiens
AATIYSLFY

SEQ ID NO: 10812 - protein, 9 aa, Homo sapiens
SFLAAATIY

SEQ ID NO: 10813 - protein, 9 aa, Homo sapiens
LAAATIYSL

SEQ ID NO: 10814 - protein, 9 aa, Homo sapiens
AATIYSLFY

SEQ ID NO: 10815 - protein, 9 aa, Homo sapiens
KSYLSGHER

SEQ ID NO: 10816 - protein, 9 aa, Homo sapiens
KSYLSGHER

SEQ ID NO: 10817 - protein, 9 aa, Homo sapiens
KTRLSTHRR

SEQ ID NO: 10818 - protein, 9 aa, Homo sapiens
TRLSTHRRI

SEQ ID NO: 10819 - protein, 9 aa, Homo sapiens
RSWEDSPER

SEQ ID NO: 10820 - protein, 9 aa, Homo sapiens
RSWEDSPER

SEQ ID NO: 10821 - protein, 9 aa, Homo sapiens
EAAKTSCLY

SEQ ID NO: 10822 - protein, 9 aa, Homo sapiens
MAQPGSGCK

SEQ ID NO: 10823 - protein, 9 aa, Homo sapiens
ARLEMDSVL

SEQ ID NO: 10824 - protein, 9 aa, Homo sapiens
HSTDCTYGR

SEQ ID NO: 10825 - protein, 9 aa, Homo sapiens
YGRDCRAPC

SEQ ID NO: 10826 - protein, 9 aa, Homo sapiens
WFEVPSSAY

SEQ ID NO: 10827 - protein, 9 aa, Homo sapiens
EVPSSAYVF

SEQ ID NO: 10828 - protein, 9 aa, Homo sapiens
TLPSTCLQK

SEQ ID NO: 10829 - protein, 9 aa, Homo sapiens
YSCDRFGGR

SEQ ID NO: 10830 - protein, 9 aa, Homo sapiens
GLWGTLFIR

SEQ ID NO: 10831 - protein, 9 aa, Homo sapiens
GLWGTLFIR

SEQ ID NO: 10832 - protein, 9 aa, Homo sapiens
RAGENKDIF

SEQ ID NO: 10833 - protein, 9 aa, Homo sapiens
YRQEREGFL

SEQ ID NO: 10834 - protein, 9 aa, Homo sapiens
SSLRQRLWR

SEQ ID NO: 10835 - protein, 9 aa, Homo sapiens
SSLRQRLWR

SEQ ID NO: 10836 - protein, 9 aa, Homo sapiens
PALPAGSSL

SEQ ID NO: 10837 - protein, 9 aa, Homo sapiens
MIDIAIDGF

SEQ ID NO: 10838 - protein, 9 aa, Homo sapiens
QYELLKLER

SEQ ID NO: 10839 - protein, 9 aa, Homo sapiens
LVFTPFASS

SEQ ID NO: 10840 - protein, 9 aa, Homo sapiens
FASSSDAFF

SEQ ID NO: 10841 - protein, 9 aa, Homo sapiens
QRHNQVPEQ

SEQ ID NO: 10842 - protein, 9 aa, Homo sapiens
SGPRGGAPR

SEQ ID NO: 10843 - protein, 9 aa, Homo sapiens
NEPLYFHTS

SEQ ID NO: 10844 - protein, 9 aa, Homo sapiens
IVFNEPLYF

SEQ ID NO: 10845 - protein, 9 aa, Homo sapiens
EPLYFHTSL

SEQ ID NO: 10846 - protein, 9 aa, Homo sapiens
FTCLPLVSL

SEQ ID NO: 10847 - protein, 9 aa, Homo sapiens
VFLEPGQVV

SEQ ID NO: 10848 - protein, 9 aa, Homo sapiens
KSFGQLSNL

SEQ ID NO: 10849 - protein, 9 aa, Homo sapiens
YELWAALPG

SEQ ID NO: 10850 - protein, 9 aa, Homo sapiens
VQYELWAAL

SEQ ID NO: 10851 - protein, 9 aa, Homo sapiens
AALPGASGV

SEQ ID NO: 10852 - protein, 9 aa, Homo sapiens
LEIPWTLSR

SEQ ID NO: 10853 - protein, 9 aa, Homo sapiens
LSRPSTNEM

SEQ ID NO: 10854 - protein, 9 aa, Homo sapiens
YTTIKTKEM

SEQ ID NO: 10855 - protein, 9 aa, Homo sapiens
FATEVFKAM

SEQ ID NO: 10856 - protein, 9 aa, Homo sapiens
VRYNCHQEI

SEQ ID NO: 10857 - protein, 9 aa, Homo sapiens
QAFERIEDY

SEQ ID NO: 10858 - protein, 9 aa, Homo sapiens
RIEDYIKLI

SEQ ID NO: 10859 - protein, 9 aa, Homo sapiens
TVLLPPNSY

SEQ ID NO: 10860 - protein, 9 aa, Homo sapiens
FDDESAEEI

SEQ ID NO: 10861 - protein, 9 aa, Homo sapiens
HTTLTLIFI

SEQ ID NO: 10862 - protein, 9 aa, Homo sapiens
HELKFFPND

SEQ ID NO: 10863 - protein, 9 aa, Homo sapiens
FPNDDPEAV

SEQ ID NO: 10864 - protein, 9 aa, Homo sapiens
NECLEAGTL

SEQ ID NO: 10865 - protein, 9 aa, Homo sapiens
EAEGRGKAV

SEQ ID NO: 10866 - protein, 9 aa, Homo sapiens
FCDPRFYQI

SEQ ID NO: 10867 - protein, 9 aa, Homo sapiens
ITAFSMPSW

SEQ ID NO: 10868 - protein, 9 aa, Homo sapiens
IEFGVSFPD

SEQ ID NO: 10869 - protein, 9 aa, Homo sapiens
RADYKYQKL

SEQ ID NO: 10870 - protein, 9 aa, Homo sapiens
GSGDLWIPV

SEQ ID NO: 10871 - protein, 9 aa, Homo sapiens
QEEITFKGC

SEQ ID NO: 10872 - protein, 9 aa, Homo sapiens
KGCMANVTV

SEQ ID NO: 10873 - protein, 9 aa, Homo sapiens
CMANVTVTR

SEQ ID NO: 10874 - protein, 9 aa, Homo sapiens
IIREGQLAV

SEQ ID NO: 10875 - protein, 9 aa, Homo sapiens
IPPDSAVEL

SEQ ID NO: 10876 - protein, 9 aa, Homo sapiens
EAPAPAAEL

SEQ ID NO: 10877 - protein, 9 aa, Homo sapiens
CESRLHTPM

SEQ ID NO: 10878 - protein, 9 aa, Homo sapiens
KLIDALIEN

SEQ ID NO: 10879 - protein, 9 aa, Homo sapiens
KASPNGKLT

SEQ ID NO: 10880 - protein, 9 aa, Homo sapiens
TENEENMQL

SEQ ID NO: 10881 - protein, 9 aa, Homo sapiens
SAFPLVRMT

SEQ ID NO: 10882 - protein, 9 aa, Homo sapiens
RMTENEENM

SEQ ID NO: 10883 - protein, 9 aa, Homo sapiens
IRFIIMVTI

SEQ ID NO: 10884 - protein, 9 aa, Homo sapiens
IMVTIWSAV

SEQ ID NO: 10885 - protein, 9 aa, Homo sapiens
VTIWSAVFL

SEQ ID NO: 10886 - protein, 9 aa, Homo sapiens
NNFSLNRRM

SEQ ID NO: 10887 - protein, 9 aa, Homo sapiens
FPMKPTTFV

SEQ ID NO: 10888 - protein, 9 aa, Homo sapiens
MTFMSPGPL

SEQ ID NO: 10889 - protein, 9 aa, Homo sapiens
MSPGPLVRV

SEQ ID NO: 10890 - protein, 9 aa, Homo sapiens
DIALIQLSS

SEQ ID NO: 10891 - protein, 9 aa, Homo sapiens
IQLSSPLEY

SEQ ID NO: 10892 - protein, 9 aa, Homo sapiens
SPLEYNSVV

SEQ ID NO: 10893 - protein, 9 aa, Homo sapiens
KPFSLLYTI

SEQ ID NO: 10894 - protein, 9 aa, Homo sapiens
QEFKFFTDL

SEQ ID NO: 10895 - protein, 9 aa, Homo sapiens
DQEDCMYWY

SEQ ID NO: 10896 - protein, 9 aa, Homo sapiens
EDCMYWYNF

SEQ ID NO: 10897 - protein, 9 aa, Homo sapiens
TFFECLQES

SEQ ID NO: 10898 - protein, 9 aa, Homo sapiens
SLLDLHTKV

SEQ ID NO: 10899 - protein, 9 aa, Homo sapiens
IRVEGKKHI

SEQ ID NO: 10900 - protein, 9 aa, Homo sapiens
FLEEYTSQL

SEQ ID NO: 10901 - protein, 9 aa, Homo sapiens
TERIIAMSF

SEQ ID NO: 10902 - protein, 9 aa, Homo sapiens
FPSSGRQSF

SEQ ID NO: 10903 - protein, 9 aa, Homo sapiens
SVTPALPSF

SEQ ID NO: 10904 - protein, 9 aa, Homo sapiens
TEFILLGFF

SEQ ID NO: 10905 - protein, 9 aa, Homo sapiens
LVTEFILLG

SEQ ID NO: 10906 - protein, 9 aa, Homo sapiens
RAGQHGRAL

SEQ ID NO: 10907 - protein, 9 aa, Homo sapiens
AAHCAGRSI

SEQ ID NO: 10908 - protein, 9 aa, Homo sapiens
HCAGRSITV

SEQ ID NO: 10909 - protein, 9 aa, Homo sapiens
YSAKAYESI

SEQ ID NO: 10910 - protein, 9 aa, Homo sapiens
KAYESIRVS

SEQ ID NO: 10911 - protein, 9 aa, Homo sapiens
LTEEIQRHL

SEQ ID NO: 10912 - protein, 9 aa, Homo sapiens
NTDPETFNV

SEQ ID NO: 10913 - protein, 9 aa, Homo sapiens
NVLEVSGSM

SEQ ID NO: 10914 - protein, 9 aa, Homo sapiens
EARKMIDQV

SEQ ID NO: 10915 - protein, 9 aa, Homo sapiens
SPYYDLDTV

SEQ ID NO: 10916 - protein, 9 aa, Homo sapiens
LIFPLRNPI

SEQ ID NO: 10917 - protein, 9 aa, Homo sapiens
FPLRNPIIY

SEQ ID NO: 10918 - protein, 9 aa, Homo sapiens
LRNPIIYTL

SEQ ID NO: 10919 - protein, 9 aa, Homo sapiens
VQKPELEMF

SEQ ID NO: 10920 - protein, 9 aa, Homo sapiens
NVLESTSCL

SEQ ID NO: 10921 - protein, 9 aa, Homo sapiens
FSTYRSSQM

SEQ ID NO: 10922 - protein, 9 aa, Homo sapiens
QLTESANHL

SEQ ID NO: 10923 - protein, 9 aa, Homo sapiens
ETNSFLKAI

SEQ ID NO: 10924 - protein, 9 aa, Homo sapiens
LDFQRALAL

SEQ ID NO: 10925 - protein, 9 aa, Homo sapiens
FVYRKDAVS

SEQ ID NO: 10926 - protein, 9 aa, Homo sapiens
YRKDAVSVV

SEQ ID NO: 10927 - protein, 9 aa, Homo sapiens
DAVSVVDTY

SEQ ID NO: 10928 - protein, 9 aa, Homo sapiens
HAAAYRNAL

SEQ ID NO: 10929 - protein, 9 aa, Homo sapiens
YRNALANPL

SEQ ID NO: 10930 - protein, 9 aa, Homo sapiens
QETFGDYPQ

SEQ ID NO: 10931 - protein, 9 aa, Homo sapiens
RVQRITQET

SEQ ID NO: 10932 - protein, 9 aa, Homo sapiens
KAKIFGTLF

SEQ ID NO: 10933 - protein, 9 aa, Homo sapiens
DPNRVVCPI

SEQ ID NO: 10934 - protein, 9 aa, Homo sapiens
SLEDQALPV

SEQ ID NO: 10935 - protein, 9 aa, Homo sapiens
KASNTSKNI

SEQ ID NO: 10936 - protein, 9 aa, Homo sapiens
LEGPAQPQS

SEQ ID NO: 10937 - protein, 9 aa, Homo sapiens
PAQPQSSPV

SEQ ID NO: 10938 - protein, 9 aa, Homo sapiens
LAKSCKVLV

SEQ ID NO: 10939 - protein, 9 aa, Homo sapiens
YETASWIIM

SEQ ID NO: 10940 - protein, 9 aa, Homo sapiens
PCYETASWI

SEQ ID NO: 10941 - protein, 9 aa, Homo sapiens
YETASWIIM

SEQ ID NO: 10942 - protein, 9 aa, Homo sapiens
RSAEQKAII

SEQ ID NO: 10943 - protein, 9 aa, Homo sapiens
KAIIRVIPL

SEQ ID NO: 10944 - protein, 9 aa, Homo sapiens
YNSSAEQVL

SEQ ID NO: 10945 - protein, 9 aa, Homo sapiens
HMAGPLCSI

SEQ ID NO: 10946 - protein, 9 aa, Homo sapiens
AARDYAGAL

SEQ ID NO: 10947 - protein, 9 aa, Homo sapiens
YAGALIRPL

SEQ ID NO: 10948 - protein, 9 aa, Homo sapiens
TSKPLVTSV

SEQ ID NO: 10949 - protein, 9 aa, Homo sapiens
LVTSVANTV

SEQ ID NO: 10950 - protein, 9 aa, Homo sapiens
PQFHTNSHV

SEQ ID NO: 10951 - protein, 9 aa, Homo sapiens
REHYHATAL

SEQ ID NO: 10952 - protein, 9 aa, Homo sapiens
HATALGAKI

SEQ ID NO: 10953 - protein, 9 aa, Homo sapiens
MALVQLERV

SEQ ID NO: 10954 - protein, 9 aa, Homo sapiens
IGGDAATTV

SEQ ID NO: 10955 - protein, 9 aa, Homo sapiens
REWAKSMTS

SEQ ID NO: 10956 - protein, 9 aa, Homo sapiens
WAKSMTSVL

SEQ ID NO: 10957 - protein, 9 aa, Homo sapiens
SVLEPVLDL

SEQ ID NO: 10958 - protein, 9 aa, Homo sapiens
TVSPGVSGV

SEQ ID NO: 10959 - protein, 9 aa, Homo sapiens
YRLAQKKPF

SEQ ID NO: 10960 - protein, 9 aa, Homo sapiens
FTGPQCQTL

SEQ ID NO: 10961 - protein, 9 aa, Homo sapiens
RLQERRSLM

SEQ ID NO: 10962 - protein, 9 aa, Homo sapiens
KAFNLSSHI

SEQ ID NO: 10963 - protein, 9 aa, Homo sapiens
SSHITTHTI

SEQ ID NO: 10964 - protein, 9 aa, Homo sapiens
WEHGASRAM

SEQ ID NO: 10965 - protein, 9 aa, Homo sapiens
NAAEVREMV

SEQ ID NO: 10966 - protein, 9 aa, Homo sapiens
FLCKFVFTI

SEQ ID NO: 10967 - protein, 9 aa, Homo sapiens
ISKDPSRLV

SEQ ID NO: 10968 - protein, 9 aa, Homo sapiens
LSRDDIRSL

SEQ ID NO: 10969 - protein, 9 aa, Homo sapiens
QFVDNPAII

SEQ ID NO: 10970 - protein, 9 aa, Homo sapiens
FILKTSQCT

SEQ ID NO: 10971 - protein, 9 aa, Homo sapiens
NASNSCTVL

SEQ ID NO: 10972 - protein, 9 aa, Homo sapiens
ETSEPVVYS

SEQ ID NO: 10973 - protein, 9 aa, Homo sapiens
VVYSLITLL

SEQ ID NO: 10974 - protein, 9 aa, Homo sapiens
LEYNSMRLI

SEQ ID NO: 10975 - protein, 9 aa, Homo sapiens
QVPEDPSTL

SEQ ID NO: 10976 - protein, 9 aa, Homo sapiens
VPEDPSTLV

SEQ ID NO: 10977 - protein, 9 aa, Homo sapiens
NAYRSYCYY

SEQ ID NO: 10978 - protein, 9 aa, Homo sapiens
VERELEKVL

SEQ ID NO: 10979 - protein, 9 aa, Homo sapiens
FAVLASIVF

SEQ ID NO: 10980 - protein, 9 aa, Homo sapiens
ILYGHTNEV

SEQ ID NO: 10981 - protein, 9 aa, Homo sapiens
DADLLIGVL

SEQ ID NO: 10982 - protein, 9 aa, Homo sapiens
VAQDGFNVT

SEQ ID NO: 10983 - protein, 9 aa, Homo sapiens
NPHACVYVS

SEQ ID NO: 10984 - protein, 9 aa, Homo sapiens
YVSRGWNQL

SEQ ID NO: 10985 - protein, 9 aa, Homo sapiens
MPMQDIKMI

SEQ ID NO: 10986 - protein, 9 aa, Homo sapiens
SAEEPLRPF

SEQ ID NO: 10987 - protein, 9 aa, Homo sapiens
RPAPARPTM

SEQ ID NO: 10988 - protein, 9 aa, Homo sapiens
TSYETADKV

SEQ ID NO: 10989 - protein, 9 aa, Homo sapiens
YNQRKADLV

SEQ ID NO: 10990 - protein, 9 aa, Homo sapiens
KADLVNRSI

SEQ ID NO: 10991 - protein, 9 aa, Homo sapiens
LATAKHDLL

SEQ ID NO: 10992 - protein, 9 aa, Homo sapiens
TAKHDLLRV

SEQ ID NO: 10993 - protein, 9 aa, Homo sapiens
ATGDDGQAV

SEQ ID NO: 10994 - protein, 9 aa, Homo sapiens
FTQSSRKQI

SEQ ID NO: 10995 - protein, 9 aa, Homo sapiens
VADHLARAL

SEQ ID NO: 10996 - protein, 9 aa, Homo sapiens
NSEEHSAKY

SEQ ID NO: 10997 - protein, 9 aa, Homo sapiens
YLSSLSLKL

SEQ ID NO: 10998 - protein, 9 aa, Homo sapiens
LSSLSLKLI

SEQ ID NO: 10999 - protein, 9 aa, Homo sapiens
EALGCPAGV

SEQ ID NO: 11000 - protein, 9 aa, Homo sapiens
CPAGVGTPV

SEQ ID NO: 11001 - protein, 9 aa, Homo sapiens
FLEDEGLYT

SEQ ID NO: 11002 - protein, 9 aa, Homo sapiens
FAFHNYNGS

SEQ ID NO: 11003 - protein, 9 aa, Homo sapiens
IVESIGEGV

SEQ ID NO: 11004 - protein, 9 aa, Homo sapiens
SIGEGVTTV

SEQ ID NO: 11005 - protein, 9 aa, Homo sapiens
GVYPELANL

SEQ ID NO: 11006 - protein, 9 aa, Homo sapiens
KPSPRPRSM

SEQ ID NO: 11007 - protein, 9 aa, Homo sapiens
TVPPAIRSY

SEQ ID NO: 11008 - protein, 9 aa, Homo sapiens
SVPEMSVVG

SEQ ID NO: 11009 - protein, 9 aa, Homo sapiens
MSVVGTSVV

SEQ ID NO: 11010 - protein, 9 aa, Homo sapiens
MALQGISVV

SEQ ID NO: 11011 - protein, 9 aa, Homo sapiens
ESMDNYSHF

SEQ ID NO: 11012 - protein, 9 aa, Homo sapiens
FEDPDVNIT

SEQ ID NO: 11013 - protein, 9 aa, Homo sapiens
EAPFDLSVV

SEQ ID NO: 11014 - protein, 9 aa, Homo sapiens
APFDLSVVY

SEQ ID NO: 11015 - protein, 9 aa, Homo sapiens
IPLVVRVFV

SEQ ID NO: 11016 - protein, 9 aa, Homo sapiens
NAEAHKSKY

SEQ ID NO: 11017 - protein, 9 aa, Homo sapiens
RQGDNCDSI

SEQ ID NO: 11018 - protein, 9 aa, Homo sapiens
NEVLIHSSQ

SEQ ID NO: 11019 - protein, 9 aa, Homo sapiens
VAGPVNEVL

SEQ ID NO: 11020 - protein, 9 aa, Homo sapiens
LKWRKIQYM

SEQ ID NO: 11021 - protein, 9 aa, Homo sapiens
KESYSVYVY

SEQ ID NO: 11022 - protein, 9 aa, Homo sapiens
YSVYVYKVL

SEQ ID NO: 11023 - protein, 9 aa, Homo sapiens
FPPGAAQAL

SEQ ID NO: 11024 - protein, 9 aa, Homo sapiens
LEFRDIASH

SEQ ID NO: 11025 - protein, 9 aa, Homo sapiens
EFRDIASHV

SEQ ID NO: 11026 - protein, 9 aa, Homo sapiens
FVLVGPLSL

SEQ ID NO: 11027 - protein, 9 aa, Homo sapiens
VLVGPLSLI

SEQ ID NO: 11028 - protein, 9 aa, Homo sapiens
LVGPLSLIL

SEQ ID NO: 11029 - protein, 9 aa, Homo sapiens
HAERKATRM

SEQ ID NO: 11030 - protein, 9 aa, Homo sapiens
IEDLNAVLF

SEQ ID NO: 11031 - protein, 9 aa, Homo sapiens
AAIEDLNAV

SEQ ID NO: 11032 - protein, 9 aa, Homo sapiens
TKCENQSGF

SEQ ID NO: 11033 - protein, 9 aa, Homo sapiens
CTLNLSCNL

SEQ ID NO: 11034 - protein, 9 aa, Homo sapiens
FTNFDLLSL

SEQ ID NO: 11035 - protein, 9 aa, Homo sapiens
NVVPSPLAG

SEQ ID NO: 11036 - protein, 9 aa, Homo sapiens
VPSPLAGPL

SEQ ID NO: 11037 - protein, 9 aa, Homo sapiens
LAGPLQPPF

SEQ ID NO: 11038 - protein, 9 aa, Homo sapiens
VNLNNELTV

SEQ ID NO: 11039 - protein, 9 aa, Homo sapiens
SSLNSASPV

SEQ ID NO: 11040 - protein, 9 aa, Homo sapiens
YSAPPDVYL

SEQ ID NO: 11041 - protein, 9 aa, Homo sapiens
TFSPHGGPI

SEQ ID NO: 11042 - protein, 9 aa, Homo sapiens
FSPHGGPIY

SEQ ID NO: 11043 - protein, 9 aa, Homo sapiens
TAQNSDIFV

SEQ ID NO: 11044 - protein, 9 aa, Homo sapiens
PASQPTPFA

SEQ ID NO: 11045 - protein, 9 aa, Homo sapiens
FALHHAASC

SEQ ID NO: 11046 - protein, 9 aa, Homo sapiens
RSLQKVRRV

SEQ ID NO: 11047 - protein, 9 aa, Homo sapiens
LLFDHLAQL

SEQ ID NO: 11048 - protein, 9 aa, Homo sapiens
AQLFFTSTI

SEQ ID NO: 11049 - protein, 9 aa, Homo sapiens
FVLDPAGDW

SEQ ID NO: 11050 - protein, 9 aa, Homo sapiens
DWYYCWLFV

SEQ ID NO: 11051 - protein, 9 aa, Homo sapiens
WYYCWLFVI

SEQ ID NO: 11052 - protein, 9 aa, Homo sapiens
LLLLGLGLS

SEQ ID NO: 11053 - protein, 9 aa, Homo sapiens
LLGLGLSTV

SEQ ID NO: 11054 - protein, 9 aa, Homo sapiens
STVTGLHCV

SEQ ID NO: 11055 - protein, 9 aa, Homo sapiens
SLASGRFTA

SEQ ID NO: 11056 - protein, 9 aa, Homo sapiens
KIAQLAVSW

SEQ ID NO: 11057 - protein, 9 aa, Homo sapiens
VHDGHSQHS

SEQ ID NO: 11058 - protein, 9 aa, Homo sapiens
FLALGGWVG

SEQ ID NO: 11059 - protein, 9 aa, Homo sapiens
ALGGWVGII

SEQ ID NO: 11060 - protein, 9 aa, Homo sapiens
ALGGWVGII

SEQ ID NO: 11061 - protein, 9 aa, Homo sapiens
TLCPALHAL

SEQ ID NO: 11062 - protein, 9 aa, Homo sapiens
KSPEGFFQV

SEQ ID NO: 11063 - protein, 9 aa, Homo sapiens
WLWDDWGPA

SEQ ID NO: 11064 - protein, 9 aa, Homo sapiens
FYTMFTPLL

SEQ ID NO: 11065 - protein, 9 aa, Homo sapiens
QVGTLTYVW

SEQ ID NO: 11066 - protein, 9 aa, Homo sapiens
YVFLRLPGA

SEQ ID NO: 11067 - protein, 9 aa, Homo sapiens
FICLLNFLI

SEQ ID NO: 11068 - protein, 9 aa, Homo sapiens
LLNFLILVV

SEQ ID NO: 11069 - protein, 9 aa, Homo sapiens
GLQERLTQV

SEQ ID NO: 11070 - protein, 9 aa, Homo sapiens
SLLQGSPHL

SEQ ID NO: 11071 - protein, 9 aa, Homo sapiens
RILQLSLTE

SEQ ID NO: 11072 - protein, 9 aa, Homo sapiens
YMYGSPGEL

SEQ ID NO: 11073 - protein, 9 aa, Homo sapiens
YMYGSPGEL

SEQ ID NO: 11074 - protein, 9 aa, Homo sapiens
MRCDIVQKI

SEQ ID NO: 11075 - protein, 9 aa, Homo sapiens
SAAFIISYV

SEQ ID NO: 11076 - protein, 9 aa, Homo sapiens
AAFIISYVV

SEQ ID NO: 11077 - protein, 9 aa, Homo sapiens
FIISYVVAV

SEQ ID NO: 11078 - protein, 9 aa, Homo sapiens
SSAAFIISY

SEQ ID NO: 11079 - protein, 9 aa, Homo sapiens
FIISYVVAV

SEQ ID NO: 11080 - protein, 9 aa, Homo sapiens
SPANSFVGT

SEQ ID NO: 11081 - protein, 9 aa, Homo sapiens
SMASPANSF

SEQ ID NO: 11082 - protein, 9 aa, Homo sapiens
CRDDSVEGL

SEQ ID NO: 11083 - protein, 9 aa, Homo sapiens
LRTTFANVV

SEQ ID NO: 11084 - protein, 9 aa, Homo sapiens
LLGSSNPPA

SEQ ID NO: 11085 - protein, 9 aa, Homo sapiens
TIIHATHSV

SEQ ID NO: 11086 - protein, 9 aa, Homo sapiens
SRDELLQVL

SEQ ID NO: 11087 - protein, 9 aa, Homo sapiens
FAMMSHHEM

SEQ ID NO: 11088 - protein, 9 aa, Homo sapiens
SHHEMNGSL

SEQ ID NO: 11089 - protein, 9 aa, Homo sapiens
VTFPHSEDV

SEQ ID NO: 11090 - protein, 9 aa, Homo sapiens
RAFAKNPHL

SEQ ID NO: 11091 - protein, 9 aa, Homo sapiens
AKNPHLRYI

SEQ ID NO: 11092 - protein, 9 aa, Homo sapiens
KIRHSHALV

SEQ ID NO: 11093 - protein, 9 aa, Homo sapiens
LVAENLRKL

SEQ ID NO: 11094 - protein, 9 aa, Homo sapiens
HRHEAVRRL

SEQ ID NO: 11095 - protein, 9 aa, Homo sapiens
RRLEQHRSL

SEQ ID NO: 11096 - protein, 9 aa, Homo sapiens
ALPPSLIPL

SEQ ID NO: 11097 - protein, 9 aa, Homo sapiens
KLKVLKILL

SEQ ID NO: 11098 - protein, 9 aa, Homo sapiens
KVLKILLYL

SEQ ID NO: 11099 - protein, 9 aa, Homo sapiens
KLKVLKILL

SEQ ID NO: 11100 - protein, 9 aa, Homo sapiens
ERCRLPSEL

SEQ ID NO: 11101 - protein, 9 aa, Homo sapiens
SLGHAPWIL

SEQ ID NO: 11102 - protein, 9 aa, Homo sapiens
STSQGTFTL

SEQ ID NO: 11103 - protein, 9 aa, Homo sapiens
TLPSCAVRA

SEQ ID NO: 11104 - protein, 9 aa, Homo sapiens
TVHGVTQAF

SEQ ID NO: 11105 - protein, 9 aa, Homo sapiens
FRTSHHLKV

SEQ ID NO: 11106 - protein, 9 aa, Homo sapiens
KTFRTSHHL

SEQ ID NO: 11107 - protein, 9 aa, Homo sapiens
IRRPMNAFM

SEQ ID NO: 11108 - protein, 9 aa, Homo sapiens
RRPMNAFMI

SEQ ID NO: 11109 - protein, 9 aa, Homo sapiens
LLLRLLRMI

SEQ ID NO: 11110 - protein, 9 aa, Homo sapiens
LLRMIILPL

SEQ ID NO: 11111 - protein, 9 aa, Homo sapiens
LRMIILPLV

SEQ ID NO: 11112 - protein, 9 aa, Homo sapiens
RMIILPLVV

SEQ ID NO: 11113 - protein, 9 aa, Homo sapiens
YRENMKAEL

SEQ ID NO: 11114 - protein, 9 aa, Homo sapiens
KPKEAVLMF

SEQ ID NO: 11115 - protein, 9 aa, Homo sapiens
ISFAETDGL

SEQ ID NO: 11116 - protein, 9 aa, Homo sapiens
KWTKNGEEV

SEQ ID NO: 11117 - protein, 9 aa, Homo sapiens
FSYSPIRLL

SEQ ID NO: 11118 - protein, 9 aa, Homo sapiens
YSPIRLLEV

SEQ ID NO: 11119 - protein, 9 aa, Homo sapiens
RLLEVCVPL

SEQ ID NO: 11120 - protein, 9 aa, Homo sapiens
ASFSYSPIR

SEQ ID NO: 11121 - protein, 9 aa, Homo sapiens
FSYSPIRLL

SEQ ID NO: 11122 - protein, 9 aa, Homo sapiens
HTDSPCLRV

SEQ ID NO: 11123 - protein, 9 aa, Homo sapiens
KVQSLVDTI

SEQ ID NO: 11124 - protein, 9 aa, Homo sapiens
ALAASPRQA

SEQ ID NO: 11125 - protein, 9 aa, Homo sapiens
KLPLDINPV

SEQ ID NO: 11126 - protein, 9 aa, Homo sapiens
FLRLFAQLL

SEQ ID NO: 11127 - protein, 9 aa, Homo sapiens
SRPFASTFI

SEQ ID NO: 11128 - protein, 9 aa, Homo sapiens
VLVDDAHGL

SEQ ID NO: 11129 - protein, 9 aa, Homo sapiens
FSRAYRNSI

SEQ ID NO: 11130 - protein, 9 aa, Homo sapiens
RRGAQRGEL

SEQ ID NO: 11131 - protein, 9 aa, Homo sapiens
SHFVGVEGV

SEQ ID NO: 11132 - protein, 9 aa, Homo sapiens
WLSRLLLWA

SEQ ID NO: 11133 - protein, 9 aa, Homo sapiens
ERWLSRLLL

SEQ ID NO: 11134 - protein, 9 aa, Homo sapiens
HQLGGVVEV

SEQ ID NO: 11135 - protein, 9 aa, Homo sapiens
CSSYNRGLI

SEQ ID NO: 11136 - protein, 9 aa, Homo sapiens
RRHLQPHDA

SEQ ID NO: 11137 - protein, 9 aa, Homo sapiens
GALSSSLLV

SEQ ID NO: 11138 - protein, 9 aa, Homo sapiens
STAMAVGAL

SEQ ID NO: 11139 - protein, 9 aa, Homo sapiens
MVALCSPSI

SEQ ID NO: 11140 - protein, 9 aa, Homo sapiens
ALCSPSIPL

SEQ ID NO: 11141 - protein, 9 aa, Homo sapiens
MVALCSPSI

SEQ ID NO: 11142 - protein, 9 aa, Homo sapiens
ALCSPSIPL

SEQ ID NO: 11143 - protein, 9 aa, Homo sapiens
KAFSRSSTL

SEQ ID NO: 11144 - protein, 9 aa, Homo sapiens
SLNHSWYQL

SEQ ID NO: 11145 - protein, 9 aa, Homo sapiens
GLAGIDLIL

SEQ ID NO: 11146 - protein, 9 aa, Homo sapiens
RLVWELRER

SEQ ID NO: 11147 - protein, 9 aa, Homo sapiens
LVWELRERL

SEQ ID NO: 11148 - protein, 9 aa, Homo sapiens
STVAVVVLA

SEQ ID NO: 11149 - protein, 9 aa, Homo sapiens
YHAKSKAHM

SEQ ID NO: 11150 - protein, 9 aa, Homo sapiens
GREQQVRLI

SEQ ID NO: 11151 - protein, 9 aa, Homo sapiens
GRMDRGNSL

SEQ ID NO: 11152 - protein, 9 aa, Homo sapiens
SGSSETSTV

SEQ ID NO: 11153 - protein, 9 aa, Homo sapiens
CLSNFTAPM

SEQ ID NO: 11154 - protein, 9 aa, Homo sapiens
CLSNFTAPM

SEQ ID NO: 11155 - protein, 9 aa, Homo sapiens
SLLLLHLRL

SEQ ID NO: 11156 - protein, 9 aa, Homo sapiens
LLLHLRLHT

SEQ ID NO: 11157 - protein, 9 aa, Homo sapiens
ALQTVDTEL

SEQ ID NO: 11158 - protein, 9 aa, Homo sapiens
RLCVLVLML

SEQ ID NO: 11159 - protein, 9 aa, Homo sapiens
RLCVLVLML

SEQ ID NO: 11160 - protein, 9 aa, Homo sapiens
SRIRLCVLV

SEQ ID NO: 11161 - protein, 9 aa, Homo sapiens
IRLCVLVLM

SEQ ID NO: 11162 - protein, 9 aa, Homo sapiens
RSHSGERPF

We claim:

1. A method comprising steps of:
   detecting mutation burden and/or neoantigen burden in a cancer sample from a subject;
   identifying the subject as a candidate for treatment with an immune checkpoint modulator if ≥178 nonsynonymous mutations are detected in the detecting step; and
   administering the immune checkpoint modulator comprising an antibody agent or antigen binding fragment thereof that interferes with programmed death 1 (PD-1) or its ligands to the identified candidate subject.

2. The method of claim 1, wherein the step of detecting comprises sequencing one or more exomes from the cancer sample.

3. The method of claim 1, wherein one or more of the nonsynonymous mutations are present in a neoepitope recognized by a T cell.

4. The method of claim 3, wherein the neoepitope shares a consensus sequence with an infectious agent.

5. The method of claim 1, wherein the antibody agent is pembrolizumab.

6. A method comprising steps of:
   (i) obtaining a dataset comprising data representing a marker from a cancer sample obtained from a subject having cancer, wherein the marker comprises mutation burden and/or neoantigen burden;
   (ii) identifying the subject as a candidate for treatment with an immune checkpoint modulator comprising an antibody agent or antigen binding fragment thereof that interferes with programmed death 1 (PD-1) or its ligands, wherein the presence of ≥178 nonsynonymous mutations the marker identifies the subject as a candidate for treatment with the immune checkpoint modulator; and
   (iii) administering the immune checkpoint modulator to the subject identified as a candidate for treatment with the immune checkpoint modulator.

7. The method of claim 6, wherein step (i) comprises sequencing one or more exomes from the cancer sample.

8. The method of claim 6, wherein one or more of the nonsynonymous mutations are present in a neoepitope recognized by a T cell.

9. The method of claim 8, wherein the neoepitope shares a consensus sequence with an infectious agent.

10. The method of claim 6, wherein the antibody agent is or comprises a monoclonal antibody or antigen binding fragment thereof.

11. The method of claim 10, wherein the antibody agent is pembrolizumab.

12. The method of claim 6, wherein the antibody agent specifically interacts with PD-1 or with PD-L1.

13. The method of claim 6, wherein the antibody agent interferes with PD-1.

14. The method of claim 8, further comprising a step of administering a composition comprising an immunogenic agent that is or comprises the neoepitope.

15. The method of claim 8, further comprising a step of administering a composition comprising a nucleic acid whose sequence comprises a coding sequence for the neoepitope.

16. The method of claim 6, wherein the antibody agent interferes with PD-L1.

17. A method comprising:
    administering an immune checkpoint modulator comprising an antibody agent or antigen binding fragment thereof that interferes with programmed death 1 (PD-1) or its ligands to a subject having cancer for which a marker has been detected, wherein the marker is detection of ≥178 nonsynonymous mutations.

18. The method of claim 17, wherein the cancer is selected from the group consisting of lung cancer, small cell lung carcinoma, non-small-cell lung carcinoma (NSCLC), bladder cancer, renal carcinoma, head and neck cancer, and melanoma.

* * * * *